US011198855B2

(12) United States Patent
Ha et al.

(10) Patent No.: US 11,198,855 B2
(45) Date of Patent: Dec. 14, 2021

(54) BIO-ENGINEERED HYPER-FUNCTIONAL "SUPER" HELICASES

(71) Applicant: THE BOARD OF TRUSTEES OF THE UNIVERSITY OF ILLINOIS, Urbana, IL (US)

(72) Inventors: Taekjip Ha, Baltimore, MD (US); Sinan Arslan, Urbana, IL (US)

(73) Assignee: THE BOARD OF TRUSTEES OF THE UNIVERSITY OF ILLINOIS, Urbana, IL (US)

( * ) Notice: Subject to any disclaimer, the term of this patent is extended or adjusted under 35 U.S.C. 154(b) by 396 days.

(21) Appl. No.: 15/526,905

(22) PCT Filed: Nov. 13, 2015

(86) PCT No.: PCT/US2015/060693
§ 371 (c)(1),
(2) Date: May 15, 2017

(87) PCT Pub. No.: WO2016/077763
PCT Pub. Date: May 19, 2016

(65) Prior Publication Data
US 2017/0335297 A1 Nov. 23, 2017

Related U.S. Application Data

(60) Provisional application No. 62/079,183, filed on Nov. 13, 2014.

(51) Int. Cl.
*C12N 9/14* (2006.01)
*C12N 9/90* (2006.01)
*C12P 19/34* (2006.01)

(52) U.S. Cl.
CPC .............. *C12N 9/14* (2013.01); *C12N 9/90* (2013.01); *C12Y 306/04012* (2013.01); *C12P 19/34* (2013.01)

(58) Field of Classification Search
CPC ....................................................... C12N 9/14
See application file for complete search history.

(56) References Cited

U.S. PATENT DOCUMENTS 4,683,195 A 7/1987 Mullis et al.
4,683,202 A 7/1987 Mullis
(Continued)

FOREIGN PATENT DOCUMENTS

WO 2005/082098 A2 9/2005
WO 2006/073504 A2 7/2006
(Continued)

OTHER PUBLICATIONS

Ali et al. (1997) "Kinetic measurement of the step size of DNA unwinding by *Escherichia coli* UvrD helicase," Science. 275:377-380.
(Continued)

*Primary Examiner* — Yong D Pak
(74) *Attorney, Agent, or Firm* — Lathrop GPM LLP; James H. Velema, Esq.; Laura A. Labeots

(57) ABSTRACT

Conformationally-constrained helicases having improved activity and strength are provided. Methods of making conformationally-constrained helicases having improved activity and strength are provided. Methods of using conformationally-constrained helicases having improved activity and strength are provided. The present invention is based on the discovery of novel modified helicases that show dramatically enhanced helicase activity and increased strength as compared to unmodified helicases. As described further herein, it has been surprisingly discovered that, by controlling the conformation of certain subdomains such that the helicase remains in a closed form (e.g., by covalently crosslinking the 2B domain to the 1A domain or the
(Continued)

1B domain in a Rep helicase), a highly active and strong form of the helicase is achieved.

14 Claims, 39 Drawing Sheets

Specification includes a Sequence Listing.

(56) References Cited

U.S. PATENT DOCUMENTS

| | | | |
|---|---|---|---|
| 5,168,038 | A | 12/1992 | Tecott et al. |
| 5,210,015 | A | 5/1993 | Gelfand et al. |
| 5,612,199 | A | 3/1997 | Western et al. |
| 5,925,517 | A | 7/1999 | Tyagi et al. |
| 6,124,090 | A | 9/2000 | Rose et al. |
| 6,174,670 | B1 | 1/2001 | Wittwer et al. |
| 6,261,797 | B1 | 7/2001 | Sorge et al. |
| 6,294,323 | B1 | 9/2001 | Ullman et al. |
| 6,365,375 | B1 | 4/2002 | Dietmaier et al. |
| 6,391,544 | B1 | 5/2002 | Salituro et al. |
| 6,432,360 | B1 | 8/2002 | Church et al. |
| 6,485,944 | B1 | 11/2002 | Church et al. |
| 6,511,803 | B1 | 1/2003 | Church et al. |
| 6,569,627 | B2 | 5/2003 | Wittwer et al. |
| 7,282,328 | B2 | 10/2007 | Kong et al. |
| 7,425,431 | B2 | 9/2008 | Church et al. |
| 7,662,594 | B2 | 2/2010 | Kong et al. |
| 2008/0269068 | A1 | 10/2008 | Church et al. |
| 2009/0018024 | A1 | 1/2009 | Church et al. |
| 2010/0075384 | A1 | 3/2010 | Kong et al. |
| 2010/0273164 | A1 | 10/2010 | Church et al. |
| 2013/0210019 | A1 | 8/2013 | Korfhage et al. |
| 2015/0191709 | A1* | 7/2015 | Heron ............ C12Y 599/01002 435/6.11 |

FOREIGN PATENT DOCUMENTS

| | | |
|---|---|---|
| WO | 2014/013260 A1 | 1/2014 |
| WO | 2014/158665 A1 | 10/2014 |

OTHER PUBLICATIONS

Arslan et al. (Apr. 17, 2015) "Engineering of a superhelicase through conformational control," Science. 348 (6232):344-347.
Arslan et al. (Aug. 2011) "Tuning helicase activity of *E. coli* Rep by 2B domain," Poster. In; FASEB Helicase Conference, Aug. 2, 2011. Steamboat, Colorado.
Arslan et al. (Aug. 2011) "Tuning helicase activity of *E. coli* Rep by 2B domain," Presentation Slides. In; FASEB Helicase Conference, Aug. 2, 2011. Steamboat, Colorado.
Baldari et al. (1987) "A novel leader peptide which allows efficient secretion of a fragment of human interleukin 1 beta in *Saccharomyces cerevisiae*," EMBO J. 6:229-234.
Barranco-Medina et al. (2010) "DNA Binding Induces Dimerization of *Saccharomyces cerevisiae* Pif1," Biochemistry. 49:8445-8454.
Becker-Andre et al. (1989) "Absolute mRNA quantification using the polymerase chain reaction (PCR). A novel approach by a PCR aided transcript titration assay (PATTY)," Nucleic Acids Research. 17:9437-9446.
Berg-Sørensen et al. (2004) "Power spectrum analysis for optical tweezers," Review of Scientific Instruments. 75:594-612.
Bernard et al. (1999) "Color Multiplexing Hybridization Probes Using the Apolipoprotein E Locus as a Model System for Genotyping," Anal. Biochem. 273:221-228.
Branton et al. (2008) "The potential and challenges of nanopore sequencing," Nature Biotechnology. 26:1146-1153.
Brendza et al. (2005) "Autoinhibition of *Escherichia coli* Rep monomer helicase activity by its 2B subdomain," Proc. Natl. Acad. Sci. USA. 10:10076-10081.
Brewer et al. (2008) "Laminar flow cells for single-molecule studies of DNA-protein interactions," Nature Methods. 5:517-525.
Bustamante et al. (2009) "High-resolution dual-trap optical tweezers with differential detection: an introduction," Cold Spring Harb. Protoc. 2009(10):pdb.top60.
Bustamante et al. (2009) "High-resolution dual-trap optical tweezers with differential detection: instrument design," Cold Spring Harb. Protoc. 2009(10):pdb.ip73.
Cheng et al. (2001) "*E. coli* Rep oligomers are required to initiate DNA unwinding in vitro," J. Mol. Biol. 310:327-350.
Cheng et al. (2002) "The 2B domain of the *Escherichia coli* Rep protein is not required for DNA helicase activity," Proc. Natl. Acad. Sci. USA. 99:16006-16011.
Choi et al. (2005) "Allosteric control through mechanical tension," Phys. Rev. Lett. 95:078102.
Cleary et al. (2004) "Production of complex nucleic acid libraries using highly parallel in situ oligonucleotide synthesis," Nature Methods. 1:241-248.
Clopper et al. (1934) "The use of confidence or fiducial limits illustrated in the case of the binomial," Biometrika. 26:404-413.
Comstock et al. (Apr. 16, 2015) "Direct observation of structure-function relationship in a nucleic acid processing enzyme," Science. 348: 352-354.
Dayhoff (1978) "Matrices for detecting distant relationships," In; Atlas of Protein Sequence and Structure. 5(Suppl 3):353-358.
Dayhoff (1978) "Survey of new data and computer methods of analysis," In; Atlas of Protein Sequence and Structure. 5(Suppl 3):1-8.
Dessinges et al. (2004) "Single-molecule assay reveals strand switching and enhanced processivity of UvrD," Proc. Natl. Acad. Sci. USA. 101(17):6439-6444.
Dillingham (2011) "Superfamily I helicases as modular components of DNA-processing machines," Biochemical Society Transactions. 39(2):413-423.
Diviacco et al. (1992) "A novel procedure for quantitative polymerase chain reaction by coamplification of competitive templates," Gene. 122(2):313-320.
Freeman et al. (1999) "Quantitative RT-PCR: pitfalls and potential," Biotechniques. 26(1):112-122, 124-125.
Gal et al. (1999) "Directional cloning of native PCR products with preformed sticky ends (autosticky PCR)," Mol. Gen. Genet. 260:569-573.
Gribskov (1986) "Sigma factors from *E. coli*, B. subtilis, phage SP01, and phage T4 are homologous proteins," Nucl. Acids Res. 14(16):6745-6763.
Guatelli et al. (1990) "Isothermal, in vitro amplification of nucleic acids by a multienzyme reaction modeled after retroviral replication," Proc. Natl. Acad. Sci. USA. 87(5): 1874-1878.
Ha et al. (2002) "Initiation and re-initiation of DNA unwinding by the *Escherichia coli* Rep helicase," Nature. 419:638-641.
Harada et al. (1990) "Mechanochemical coupling in actomyosin energy transduction studied by in vitro movement assay," J. Mol. Biol. 216:49-68.
Huang et al. (2006) "Interdomain conformational changes in Akt activation revealed by chemical cross-linking and tandem mass spectrometry," Mol. Cell Proteomics. 5:1045-1053.
Jaffe et al. (2000) "An artificial gene for human porphobilinogen synthase allows comparison of an allelic variation implicated in susceptibility to lead poisoning," J. Biol. Chem. 275(4):2619-2626.
Jia et al. (2011) "Rotations of the 2B sub-domain of *E. coli* UvrD helicase/translocase coupled to nucleotide and DNA binding," J. Mol. Biol. 411:633-648.
Joo et al. (Oct. 2012) "Preparing sample chambers for single-molecule FRET," Cold Spring Harb Protoc. 2012 (10):1104-1108.
Kaufman et al. (1987) "Translational efficiency of polycistronic mRNAs and their utilization to express heterologous genes in mammalian cells," EMBO J. 6(1):187-193.
Khafizov (Sep. 18, 2012) "Single molecule force spectroscopy of single stranded DNA binding protein and rep helicase," Ph.D. Dissertation University of Illinois at Urbana-Champaign. pp. 1-96.
Korolev et al. (1997) "Major domain swiveling revealed by the crystal structures of complexes of *E. coli* Rep helicase bound to single-stranded DNA and ADP," Cell. 90(4):635-647.

(56) References Cited

OTHER PUBLICATIONS

Kurjan et al. (1982) "Structure of a yeast pheromone gene (MF alpha): a putative alpha-factor precursor contains four tandem copies of mature alpha-factor," Cell. 30:933-943.

Kwoh et al. (1989) "Transcription-based amplification system and detection of amplified human immunodeficiency virus type 1 with a bead-based sandwich hybridization format," Proc. Natl. Acad. Sci. USA. 86(4): 1173-1177.

Kwok (2000) "High-throughput genotyping assay approaches," Pharmocogenomics 1:95-100.

Landegren et al. (1988) "A ligase-mediated gene detection technique," Science. 241:1077-1080.

Landegren et al. (1998) "Reading bits of genetic information: methods for single-nucleotide polymorphism analysis," Genome Res. 8:769-776.

Landry et al. (2009) "Characterization of photoactivated singlet oxygen damage in single-molecule optical trap experiments," Biophysical Journal. 97:2128-2136.

Laszlo et al. (Jun. 25, 2014) "Decoding long nanopore sequencing reads of natural DNA," Nat. Biotechnol. 32 (8):829-833.

Lee et al. (2006) "UvrD helicase unwinds DNA one base pair at a time by a two-part power stroke," Cell. 127 (7):1349-1360.

Lee et al. (Jun. 2012) "Elastic coupling Between RNA Degradation and Unwinding by an Exoribonuclease," Science. 336(6089):1726-1729.

Lizardi et al. (1988) "Exponential Amplification of Recombinant-RNA Hybridization Probes," BioTechnology 6:1197-1202.

Lohman et al. (2008) "Non-hexameric DNA helicases and translocases: mechanisms and regulation," Nat. Rev. Mol. Cell. Biol. 9:391-401.

Lucklow et al. (1989) "High level expression of nonfused foreign genes with Autographa californica nuclear polyhedrosis virus expression vectors," Virology. 170:31-39.

Machon et al. (2010) "RepD-mediated recruitment of PcrA helicase at the Staphylococcus aureus pC221 plasmid replication origin, oriD," Nucleic Acids Research. 38(6):1874-1888.

Mackay et al. (2002) "Real-time PCR in virology," Nucleic Acids Research. 30:1292-1305.

Maluf et al. (2003) "A Dimer of Escherichia coli UvrD is the active form of the helicase in vitro," Journal of Molecular Biology. 325:913-935.

Manthei et al. (Mar. 23, 2015) "Structural mechanisms of DNA binding and unwinding in bacterial RecQ helicases," Proc. Natl. Acad. Sci. USA. 112(14):4292-4297.

Mechanic et al. (2000) "Escherichia coli MutL loads DNA helicase II onto DNA," J. Biol. Chem. 275:38337-38346.

Moffitt et al. (2009) "Intersubunit coordination in a homomeric ring ATPase," Nature. 457(7228):446-450.

Mullis et al. (1986) "Specific enzymatic amplification of DNA in vitro: the polymerase chain reaction," Cold Spring Harb. Symp. Quant. Biol. 51 (Pt 1):263-273.

Murphy et al. (2004) "Probing single-stranded DNA conformational flexibility using fluorescence spectroscopy," Biophysical Journal 86:2530-2537.

Myong et al. (2005) "Repetitive shuttling of a motor protein on DNA," Nature. 437:1321-1325.

Nakazawa et al. (1994) "UV and skin cancer: specific p53 gene mutation in normal skin as a biologically relevant exposure measurement," Proc. Natl. Acad Sci. USA. 91:360-364.

Niedziela-Majka et al. (2007) "Bacillus stearothermophilus PcrA monomer is a single-stranded DNA translocase but not a processive helicase in vitro," Journal of Biological Chemistry 282(37):27076-27085.

Park et al. (2010) "PcrA helicase dismantles RecA filaments by reeling in DNA in uniform steps," Cell. 142:544-555.

Perkins et al. (2004) "Forward and reverse motion of single RecBCD molecules on DNA," Biophysical Journal. 86:1640-1648.

Porreca et al. (2007) "Multiplex amplification of large sets of human exons," Nat. Methods 4:931-936.

Qi et al. (May 28, 2013) "Sequence-dependent base pair stepping dynamics in XPD helicase unwinding," Elife. 2:e00334.

Raney et al. (2013) "Structure and Mechanisms of SF1 DNA Helicases," Adv. Exp. Med. Biol. 767:17-46.

Rasnik et al. (2004) "DNA-binding orientation and domain conformation of the E. coli rep helicase monomer bound to a partial duplex junction: single-molecule studies of fluorescently labeled enzymes," Journal of Molecular Biology. 336:395-408.

Rasnik et al. (2006) "Nonblinking and long-lasting single-molecule fluorescence imaging," Nat. Methods. 3:891-893.

Roy et al. (2008) "A practical guide to single-molecule FRET," Nat. Methods. 5:507-516.

Schierling et al. (2010) "Controlling the enzymatic activity of a restriction enzyme by light," Proc. Natl. Acad. Sci. USA. 107:1361-1366.

Schultz et al. (1987) "Expression and secretion in yeast of a 400-kDa envelope glycoprotein derived from Epstein-Barr virus," Gene 54:113-123.

Seed (1987) "An LFA-3 cDNA encodes a phospholipid-linked membrane protein homologous to its receptor CD2," Nature. 329(6142):840-842.

Shi (2001) "Enabling large-scale pharmacogenetic studies by high-throughput mutation detection and genotyping technologies," Clin. Chem. 47:164-172.

Slatter et al. (2009) "PcrA helicase tightly couples ATP hydrolysis to unwinding double-stranded DNA, modulated by the initiator protein for plasmid replication, RepD," Biochemistry. 48:6326-6334.

Smith et al. (1981) "Comparison of biosequences," Advances in Applied Mathematics. 2:482-489.

Smith et al. (1983) "Production of human beta interferon in insect cells infected with a baculovirus expression vector," Mol. Cell. Biol. 3:2156-2165.

Smith et al. (1988) "Single-step purification of polypeptides expressed in Escherichia coli as fusions with glutathione S-transferase," Gene. 67:31-40.

Soultanas et al. (1998) "Escherichia coli ribosomal protein L3 stimulates the helicase activity of the Bacillus stearothermophilus PcrA helicase," Nucleic Acids Research. 26:2374-2379.

Soultanas et al. (1999) "Plasmid replication initiator protein RepD increases the processivity of PcrA DNA helicase," Nucleic Acids Res. 27:1421-1428.

Subramanya et al. (1996) "Crystal structure of a DExx box DNA helicase," Nature. 384:379-383.

Sun et al. (2008) "Impediment of E. coli UvrD by DNA-destabilizing force reveals a strained-inchworm mechanism of DNA unwinding," EMBO J. 27:3279-3287.

Tomishige et al. (2000) "Controlling kinesin by reversible disulfide cross-linking. Identifying the motility-producing conformational change," J Cell Biol. 151:1081-1092.

Urbatsch et al. (2001) "Cysteines 431 and 1074 are responsible for inhibitory disulfide cross-linking between the two nucleotide-binding sites in human P-glycoprotein," J. Biol. Chem. 276:26980-26987.

Veine et al. (1998) "Thioredoxin reductase from Escherichia coli: evidence of restriction to a single conformation upon formation of a crosslink between engineered cysteines," Protein Science. 7:369-375.

Velankar et al. (1999) "Crystal structures of complexes of PcrA DNA helicase with a DNA substrate indicate an inchworm mechanism," Cell. 97(1):75-84.

Vincent et al. (2004) "Helicase-dependent isothermal DNA amplification," EMBO Reports. 5:795-800.

Volgraf et al. (2006) "Allosteric control of an ionotropic glutamate receptor with an optical switch," Nature Chemical Biology. 2(1):47-52.

Williams et al. (2002) "In vivo protein cyclization promoted by a circularly permuted Synechocystis sp. PCC6803 DnaB mini-intein," J. Biol. Chem. 277:7790-7798.

Yamaguchi et al. (1998) "MutS and MutL activate DNA helicase II in a mismatch-dependent manner," J. Biol. Chem. 273:9197-9201.

Yanagida et al. (1984) "Direct observation of motion of single F-actin filaments in the presence of myosin," Nature. 307:58-60.

(56) References Cited

OTHER PUBLICATIONS

Yancey et al. (1991) "The DNA unwinding reaction catalyzed by Rep protein is facilitated by an RHSP-DNA Interaction," Nucleic Acids Research. 19:3943-3951.
Yodh et al. (2009) "BLM helicase measures DNA unwound before switching strands and hRPA promotes unwinding reinitiation," The EMBO Journal. 28:405-416.
Yodh et al. (2010) "Insight into helicase mechanism and function revealed through single-molecule approaches," Quarterly Reviews of Biophysics. 43(2):185-217.
Zhang et al. (2007) "Directional loading and stimulation of PcrA helicase by the replication initiator protein RepD," Journal of Molecular Biology. 371(2):336-348.
Zimmerman et al. (1996) "Technical aspects of quantitative competitive PCR," Biotechniques. 21:268-279.
International Search Report with Written Opinion corresponding International Patent Application No. PCT/US2015/060693, dated Mar. 4, 2016.
Supplementary European Search Report for EP 15858164.5 dated Mar. 12, 2018, 5 pages.

\* cited by examiner

Supplementary Table S2. Conserved Cys247 in Motif III of PcrA

| | | Motif Ia | | TxGx Motif | |
|---|---|---|---|---|---|
| Rep | Escherichia coli | RIAHLIRGCGYQARHIAAVTFTNKAAREMKERVGQTLGRK-EARGLMISTFHTLGLDIIK | 93 |
| UvrD | Escherichia coli | RIAWLMSVENCSPYSIMAVTFTNKAAAEMRHRIGQLMGT--SQGGMWVGTFHGLAHRLLR | 99 |
| UvrD | Mycobacterium tuberculosis | RIAYLMAARGVGVGQILAITFTNKAAAEMRERVGLVGE--KARYMWVSTFHSTSVRILR | 112 |
| UvrD | Mycoplasma capricolum | KIAYLIEKQNIDPSRILAVTFTNKAAKEMKERVLQITNN--SFKSPFISTFHSWSKVLR | 99 |
| UvrD | Deinococcus radiodurans | RIAHLIGHYGVHPGEILAVTFTNKAAEMRERAGHLVPG---AGDLWMSTFHSAGVRILR | 101 |
| PcrA | Geobacillus sterothermophilus | RIAYLMAEKHVAPWNILAITFTNKAAREMRERVQSLLGG--AAEDVWISTFHSMCVRILR | 101 |
| PcrA | Bacillus subtilis | RIAYLMAEKHVAPWNILAITFTNKAAREMKERVESILGP---GADDIWISTFHSMCVRILR | 101 |
| PcrA | Staphylococcus aureus | RIAYLLDEKDVSPYNVLAITFTNKAAREMKERVQKLVGD--QAEVIWMSTFHSMCVRILR | 97 |
| PcrA | Leuconostoc citreum | RIAHLVQDLNVFPWRILAITFTNKAAREMRERIAALLSED--VARDIWVSTFHALAVRILR | 100 |
| PcrA | Fructobacillus fructosus | RVAHLIEDLDVRPWRILAITFTNKAAREMRERIAKLVDPE--QAQAVWVSTFHALAVRILR | 100 |
| PcrA | Staphylococcus epidermis | RIAYLLDEKDVSPYNILAITFTNKAAREMKARVEHLVGE---EAQVIWMSTFHSMCVRILR | 97 |
| PcrA | Carnobacterium maltaromaticum | RIAYLIEEKQVNPWNILAITFTNKAAREMKERVNRLNVR---GGNDVWVSTFHSMCVRILR | 100 |
| PcrA | Alloiococcus otitis | RIAYLIQEKGVNPWNILAITFTNKAAGEMKDRVQKLVSQ---GGSGVWVSTFHSMCVRILR | 100 |
| PcrA | Mitsuokella multacida | RIANLLA--QGVAPYSILAITFTNKAATEMRERVDRMIGD--AAKDVWLSTFHSFCARFLR | 99 |
| PcrA | Alkaliphilus metalliredigens | RIAQILS--QGVRPYNILSITFTNKAAREMKERIHQLLGD--GFRDLWVSTFHSSQVRILR | 95 |
| PcrA | Desulfotomaculum reducens | RIAYLIKEREVNPYNILAITFTNKAANEMRARVENLVPQ---AAKDLWVTFHSAQLRILR | 95 |
| PcrA | Listeria fleischmannii | RIAYLVVEKQVYPSNILAITFTNKAAREMKARVTGLLGG---IAESIWMSTFHSMCVRILR | 101 |
| PcrA | Sporosarcina newyorkensis | RIAYLVIEKAVNPWNILAITFTNKAAREMRERIDGLLGAG--SGERMWVSTFHSMCVRILR | 102 |
| PcrA | Kurthia massiliensis | RIAYLIREKMIPPYAILAITFTNKAAREMKERIDRIDGLLGNG--SGQQMWVSTFHSMCVRILR | 102 |
| PcrA | Marinococcus halotolerans | RIAYLVLEKQVYPSNILAITFTNKAAREMKERIDGLLGNG---VAEDIWMSTFHSMCVRILR | 102 |
| PcrA | Planococcus antarcticus | RIAYLVIEKEVYPSKILAITFTNKAAREMRDRIDGILGNG--TGDSMWVSTFHSMCVRILR | 102 |
| PcrA | Lysinibacillus fusiformis | RIAYLMGEKDVSPRNILAITFTNKAAREMKERIDGILGNG--TGDSMWVSTFHSMCVRILR | 102 |
| PcrA | Oceanobacillus iheyensis | RIAYLLEEKDVAARNILAITFTNKAAREMKERVSKLVGP---QGEYMWVSTFHSMCVRILR | 101 |
| PcrA | Virgibacillus sp. | RIAYLIAEKGVNPYNILAITFTNKAAREMKERVRRLVGS---ESDQMWVSTFHSMCVRILR | 101 |
| PcrA | Caldibacillus debilus | RIAYLLSEKDVAPRNILAITFTNKAAREMKDRVESLVGK---TAAEVWISTFHAMCVKILR | 118 |
| PcrA | Halobacillus halophilus | RIAYLLGEKEVSPRNILAITFTNKAAREMKERITDLVGS---DGEKIWMSTFHSMCVRILR | 101 |
| PcrA | Gracilibacillus halophilus | RIAYLLGEKGVAPWNILAITFTNKAAREMKERITDTLVGP---RGADMWVSTFHSMCVRILR | 100 |
| PcrA | Bacillus cereus | RIAYLIDEKDVSPYKILAITFTNKAAREMKERVKKIIGD---EAEDIWISTFHSMCVRILR | 97 |
| PcrA | Macrococcus caseolyticus | RVAYLLAEKGIHPWNVLAITFTNKAAREMRIGQLVGP---MAEEIWISTFHSMCVRMLR | 101 |
| PcrA | Laceyella sacchari | RISYLVGYKQAFPWSILAITFTNKAAREMKERVERMVGRDAGADDIWISTFHSMCVRILR | 102 |
| PcrA | Brevibacillus laterosporus | RIAYLIATRKAPPWAILAITFTNKAAREMQDRVSRLVGG-P-EGRDIWVSTFHSMCVRILR | 102 |
| PcrA | Paenibacillus sp. | RIAYLIGKKRVAPWSILAITFTNKAAREMQERVEALV-GP--GASDIWVSTFHSMCVRILR | 109 |
| PcrA | Thermobacillus composti | RIAYLLDEKDVSPRNILAITFTNKAAREMKDRVTNLIGP---EADQMWVSTFHSMCVRILR | 103 |
| PcrA | Amphibacillus xylanus | RIAYLLDEKDVSPRNILAITFTNKAAREMKDRVTNLIGP---EADQMWVSTFHSMCVRILR | 102 |

Fig. 4A

|  |  |  | Motif II (Walker) |  | Motif III |  |
|---|---|---|---|---|---|---|
| Rep | Escherichia coli | WQNKTIRYLLVDEYQDTNTSQYELVKLLVGSRA | ---- | RFTVVGDDDQSIYSWRGARPQ | 256 |
| UvrD | Escherichia coli | YRERFTNILVDEFQDTNIQYAWIRLLAGDTG | ---- | KVMIVGDDDQSIYGWRGAQVE | 262 |
| UvrD | Mycobacterium tuberculosis | YRRRFRHVLVDEYQDTNHAQVLVRELVGRDSNDGIPPGELQ | VVGDADQSIYAFRGATIR | 287 |
| UvrD | Mycoplasma capricolum | WRNAYDYVLVDEFQDTNELQFSLIKFLTINTN | ---- | HLTVVGDPDQTIYSWRGAKLD | 267 |
| UvrD | Deinococcus radiodurans | YQNKAKFIHVDEYQDTNELQFSLTRLLASRDR | ---- | NLIVVGDDDQSIYKFRGADIQ | 269 |
| PcrA | Geobacillus sterothermophilus | YQYKFQYIHIDEYQDTNRAQYTLVKKLAERFQ | ---- | NICAVGDADQSIYRWRGADIQ | 265 |
| PcrA | Bacillus subtilis | YQRKFQYIHVDEYQDTNRAQYMLVKQLAERFQ | ---- | NLVVGDSDQSIYRWRGADIT | 265 |
| PcrA | Staphylococcus aureus | YQRKFQYIHVDEYQDTNKAQYTLVKLLASKFK | ---- | NLIVVGDDDQSIYGWRGADIQ | 261 |
| PcrA | Leuconostoc citreum | YQQFEYLHVDEFQDTNMAQYTIVNLLAQRSK | ---- | NLAVVGDADQSIYGWRGANMN | 264 |
| PcrA | Fructobacillus fructosus | YQDQFRYLHVDEYQDTNDAQYLIVNMLAQGSK | ---- | NLAVVGDADQSIYGWRGANMQ | 264 |
| PcrA | Staphylococcus epidermis | YQNKFQYIHVDEYQDTNKAQYTLVKLLANKFK | ---- | NLIVVGDSDQSIYGWRGADIQ | 261 |
| PcrA | Carnobacterium maltaromaticum | YQNKFHYIHVDEYQDTNHAQYTLVNTLAKRFK | ---- | NLIVVGDADQSIYGWRGANME | 264 |
| PcrA | Alloiococcus otitis | YQAKFQYIHVDEYQDTNQAQYQLVQLLAQRFK | ---- | NVVVGDDDQSIYGWRGADMG | 264 |
| PcrA | Mitsuokella multacida | YQGRFRYILVDEYQDTNGAQYQLTKILAARHH | ---- | NLIVVGDADQSIYGWRGADIR | 264 |
| PcrA | Alkaliphilus metalliredigens | YQEKFKYILVDEFQDTNMAQYTLVSLLAKKHH | ---- | NLIVVGDDDQSIYGWRGADIR | 261 |
| PcrA | Desulfotomaculum reducens | YQEKFKYILVDEYQDTNHTQYVLVNMLAESHR | ---- | NVIVVGDPNQSIYKWRGADIN | 259 |
| PcrA | Listeria fleischmannii | YQRKFQYILVDEYQDTNHAQYLLVKLFAAKLR | ---- | NLIVVGDSDQSIYGWRGADIS | 265 |
| PcrA | Sporosarcina newyorkensis | YQNKFQYIHVDEYQDTNFSQYRLVQMLASKFR | ---- | NVIVVGDSDQSIYRWRGADIG | 268 |
| PcrA | Kurthia massiliensis | YQRKFHYIHVDEYQDTNKSQYLLVKLLAAKRH | ---- | NLIVVGDSDQSIYRWRGADIT | 268 |
| PcrA | Marinococcus halotolerans | YQRKFQYIHVDEYQDTNRAQYMLVNMLAAKRH | ---- | NLIVVGDSDQSIYRWRGADIG | 266 |
| PcrA | Planococcus antarcticus | YQRKFHYIHVDEYQDTNKSQYLLVQKLASKFK | ---- | NLIVVGDSDQSIYRWRGADIG | 268 |
| PcrA | Lysinibacillus fusiformus | YQRKFQYIHVDEYQDTNKSQYLLVQLLAKKFK | ---- | NLIVVGDSDQSIYRWRGADIG | 268 |
| PcrA | Oceanobacillus iheyensis | YQRRFQYIHVDEYQDTNHAQYYLLVKQLASRFQ | ---- | NLIVVGDSDQSIYRWRGADIG | 265 |
| PcrA | Virgibacillus sp. | YQRKFQYIHVDEYQDTNRAQYELVRLLSARFQ | ---- | NIIVVGDSDQSIYRWRGADIS | 265 |
| PcrA | Caldibacillus debilis | YQRKFQYIHVDEYQDTNRAQYLVQLASRYK | ---- | NLIVVGDSDQSIYRWRGADIS | 283 |
| PcrA | Halobacillus halophilus | YQRRFQYIHVDEYQDTNRAQYLVQLASRFQ | ---- | NIIVVGDSDQSIYRWRGADIS | 265 |
| PcrA | Gracilibacillus halophilus | YQRRFQYIHVDEYQDTNRAQYYLVKQLASRFQ | ---- | NIIVVGDSDQSIYRWRGADIS | 265 |
| PcrA | Bacillus cereus | YQRKFQYIHVDEYQDTNRAQYLLVKHLAARFK | ---- | NLIVVGDSDQSIYRWRGADIS | 266 |
| PcrA | Macrococcus caseolyticus | YQSKFQYIHVDEYQDTNRAQYLLVKMLADKFK | ---- | NIIVVGDSDQSIYRWRGADIY | 261 |
| PcrA | Laceyella sacchari | YQNKFQYIHVDEYQDTNHVQYILTKMLAEKHQ | ---- | NIIVVGDSDQSIYRWRGADIT | 265 |
| PcrA | Brevibacillus laterosporus | YQRKFQYIHVDEYQDTNRAQYLVKMLADMHK | ---- | NIIVVGDSDQSIYRWRGADIS | 266 |
| PcrA | Paenibacillus sp. | YQRKFRYIHVDEYQDTNRAQYMLCRMLADKHH | ---- | RICVVGDSDQSIYRWRGADIS | 266 |
| PcrA | Thermobacillus composti | YQNKFRYIHVDEYQDTNRAQYLLCRMLADKHH | ---- | NIIVVGDSDQSIYRWRGADIT | 273 |
| PcrA | Amphibacillus xylanus | YQRRFQYIHVDEYQDTNYAQYDLVKKLAEKYQ | ---- | NLIVVGDSDQSIYRWRGADIK | 266 |

*Fig. 4B*

Target Residues

```
P56255 PCRA_GEOSE   1  MNFLSEQLLAHLNKEQQEAVRTTEGPLLIMAGAGSGKTRVLTHRIAYLMAEKHVAPWNIL   60
P09980 REP_ECOLI    1  ------------MRLNPGQQQAVEFVTGPCLVLAGAGSGKTRVITNKIAHLIRGCGYQARHIA   51
P03018 UVRD_ECOLI   1  --MDVSYLLDSLNDKQREAVAAPRSNLLVLAGAGSGKTRVLVHRIAWLMSVENCSPYSIM   58
                          **  *::**    . *::*********: :** *:    *

P56255 PCRA_GEOSE  61  AITFTNKAAREMRERVQSLLGGA-AEDVWISTFHSMCYRILRRDIDRIGINRNFSILDPT  119
P09980 REP_ECOLI   52  AVTFTNKAAREMKERVQTLGRKEARGLMISTFHTLGLDIIKREYAALGMKANFSLFDDT  111
P03018 UVRD_ECOLI  59  AVTFTNKAAAEMRHRIGQLMGTS-QGGMWVGTFHGLAHRLLRAHHMDANLPQDFQILDSE  117
                       *:*******  **:  *:.  :*  :    :  .***    :::.    :  :*.::*

P56255 PCRA_GEOSE 120  DQLSVMKTILKEKNIDPKKFEPRTILGTISAAKNELLPPEQFAKRASTYYEKVVSDVVQF  179
P09980 REP_ECOLI  112  DQLALLKELTEGLIEDD-KVLLQQLISTISNWKNDLKTPSQAAASAIGERDRIFAHCYGL  170
P03018 UVRD_ECOLI 118  DQLRLLKRLIKAMNLDEKQWPPRQAMWYINSQKDEGLRPHHIQSYG-NPVEQTWQKVYA  176
                      ***  :*  :  . *    :     :  *   *:*     *  *:    : : :*

P56255 PCRA_GEOSE 180  VQQRLLRNISLDFPDLLMTTIQLFDRVPDVLHYYQYKFQYIHIDEYQDTNRAQYTLVKKL  239
P09980 REP_ECOLI  171  YDAHLKACNVLDFPDLILLPTLLLQRNEEVRKRWQNKIRYLLVDEYQDTNSQYELVKLL  230
003018 UVRD_ECOLI 177  YQEACDRAGLVDFAELLRAHELWLNKPHILQHYRERFTNILVDEFQDTNNIQYAWIRLL  236
                      *:      :.*  :**  *::*     *   . .:  ::  :: . :**:**** ** :: *

P56255 PCRA_GEOSE 240  AERFQNICAVGDADQSIYRWRGADIQNILSFERDYPNAKVILLEQNYRSTKRILQAAANEV  299
P09980 REP_ECOLI  231  VGSRARFTVVGDDDQSIYSWRGARPQNLVLLSQDFPALKVIKLEQNYRSSGRILKAANIL  290
P03018 UVRD_ECOLI 237  AGDTGKVMIVGDDDQSIYGWRGAQVENIQRFLNDFPGAETIRLEQNYRSTSNILSAANAL  296
                       .  ..   ***  ***** ****   *:    :  .:.* :.*  *******: .**. ***  :

P56255 PCRA_GEOSE 300  IEHNVNRKPKRIWTENPEGKPILYYEAMNEADEAQFVAGRIREAVERGERRYRDFAVLYR  359
P09980 REP_ECOLI  291  IANNPHVFEKRLFSELGYGAELKVLSANNEEHEAERVTGELIAHHFVNKTQYKDYAILYR  350
P03018 UVRD_ECOLI 297  IENNNGRLGKKLWTDGADGEPISLYCAFNELDEARFVVNRIKTWQDNGG--ALAECAILYR  355
                      * .*    *:::::       *    *   * ** .**. *.      :  *:*:

P56255 PCRA_ECOLI 360  TNAQSRVMEEMLLKANIPYQIVGGLKFYDRKEIKDIAVLRVLANPDDDLSLLRIINVPK  419
P09980 REP_ECOLI  351  GNHQSRVFEKFLMQNRIPYKISGGTSFFSRPEIKDLAYLRVLTNFDDDSAKLRIVNTPK  410
P03018 UVRD_ECOLI 356  SNAQSRVLEEALLQASMPYRIYGGMRFFERQEIKDASYLRLLANRNDDAAIERVVNTPT  415
                      * ****:*: ::.:  :***:* ** **  *: .* **** *: ***:*   :  :*.*.

P56255 PCRA_GEOSE 420  RGIGASTIDKIVRYAADHELSLFEALGELEM-IGLGAKAAGALAAFRSQLEQWTQLQEYV  478
P09980 REP_ECOLI  411  REIGPATLKKGEWANTRNKSMFTASFDMGLSQTLSGRGYEALTRFTHWLAEIQRLAERE  470
P03018 UVRD_ECOLI 416  RGIGDRTLDVVRQTSDRQLTLFQACRELLQEKALAGRAASALQRFMELIDALAQETADM  475
                      * **  *:.  :    .:       *..  *  **  :

P56255 PCRA_GEOSE 479  SVTELVEEVLDKSGYREM-LKAE-RTIEAQSRLENLDEFLSVTKIHFENVSDDKSLTAR--  534
P09980 REP_ECOLI  471  PIAAVRDL-IHGMDYESWLYETSPSPKAAEMRMKNVNQLFSWMTEMLEGSELDFPMTLTR  529
P03018 UVRD_ECOLI 476  PLHVQTDRVIKDSGLRTM-YEQE-KGEKGQTRIENLEELVTATRQFSYMEEDDLMPLQA  533
                        :   .      :.,   .     *,    .: *:* :: :,  .:  .., .:

P56255 PCRA_ECOLI 535  LTDLAIISDLDELDGTEQAAAEGDAVMLMTLHAAKGLEFPVVFLIGMEEGIFPHNRSLED  593
P09980 REP_ECOLI  530  VTRFTI----RDMMERGESEEELDQVQLMTLHASKGLEFPYVYMVGMEEGFLPHQSSIDE  586
P03018 UVRD_ECOLI 534  ILSHAAIEA--------GEGQADTWQDAVQLMTLHSAKGLEFPQVFIVGMEEGMFPSQMSLDE  588
                      ::  :*     :    *  **  *******:::*****  :: *

P56255 PCRA_GEOSE 594  DDEMEEERRLAYVGITRAEEELVLTSAQMRTLFGNIQMDPPSRFLNEIPAHLLETASRRQ  653
P09980 REP_ECOLI  587  D-NIDEERRLAYVGITRAQKELTFTLCKERRQYGELVRPEPSRFLLELPQDDLIWEQERK  645
P03018 UVRD_ECOLI 589  GGRLEEERRLAYVGVTRAMQKLTLTYAETRRLYGKEVYHRPSRFIGELPEECVEEVRLEA  648
                        .::**********:***  ::.:*   *:     ****:  *:.   :       *

P56255 PCRA_GEOSE 654  AGASRPAVSRP-----QASGAVGSWKVGDRANHRKWGTGTVVSVRGGGDDQELDIAFPSPIG  710
P09980 REP_ECOLI  646  VVSAEERM--QKGQSHLANLKAMMAA-------KRGK-------------------------  673
P03018 UVRD_ECOLI 649  -TVSRPVSHQRMGTPMVENDSGYKLGQRVRHAKFGEGTIVNMEGSEHSRLQVAFQG-QG  706
                        :,  :*            , . . .         * *

P56255 PCRS_GEOSE 711  IKRLLAKFAPIEKV                                              724
P09980 REP_ECOLI  674  ---------------                                             673
P03018 UVRD_ECOLI 707  IKWLVAAYARLESV                                              720
```

Domain 1A  
Domain 1B  
Domain 2B

*Fig. 9A*

Domain 1A
Target Residues

```
P09980         REP_ECOLI         60  AREMKERVGQTLGRKEARGLMIST HTLGLDIIKREYAALGMKANFSLF DDTDQLALLKE  119
O51889         REP_BUCAP         60  AHEIKVRLAKHLNLLQIKKMIIST HSLGLEIIKKEINTLKFNSNFSLF DERDQMMLLKK  119
P57654         REP_BUCAI         60  AYEMRIRLSKYLNIPEIKKIIIST HSLGLEIIKKEIDALELNNNFTLL DEKDQILLLKK  119
P44804         REP_HAEIN         60  AREMKERVAHSIGKEQSKGLLVST HTLGFDILKREYKALGFKSNMTLF DEHDQFALLKE  119
Q9L6S1         REP_SALTY         60  AREMKERVGQTLGRKEARGLMIST HTLGLDIIKREYAALGMKSNFSLF DDTDQVALLKE  119
A0A077ZIR6     A0A077ZIR6_TRITR  77  AREMKERVGQTLGRKEARGLMIST HTLGLDIIKREYAALGMKANFSLF DDTDQLALLKE  136
S3IEG5         S3IEG5_9ENTR      60  AREMKERVGQTLGRKEARGLMIST HTLGLEIIKREYAALGMKSNFSLF DDTDQTALLKE  119
J1R585         J1R585_9ENTR      60  AREMKERVAQTLGRKEARGLMIST HTLGLTIIKREFAALGMKSNFSLF DDTDQVALLKE  119
K8ABZ8         K8ABZ8_9ENTR      41  AREMKERVAQTLGRKEARGLMIST HTLGLEIIKREYAALGMKSNFSLF DDTDQMALIKE  100
A0A060VJ91     A0A060VJ91_KLEPN 121  AREMKERVGQTLGRKEARGLMIST HTLGLDIIKREYAALGMKSNFSLF DDTDQVALLKE  180
A0A090V5M6     A0A090V5M6_ESCVU  60  AREMKERVGQTLGRKEARGLMIST HTLGLDIIKREYAALGMKSNFSLF DDTDQVALLKD  119
A0A083YZC2     A0A083YZC2_CITAM  60  AREMKERVGQTLGRKEARGLMIST HTLGLEVIKREYAALGMKSNFSLF DDTDQVALLKD  119
A0A0J6D7T8     A0A0J6D7T8_SALDE  60  AREMKERVGQTLGRKEARGLMIST HTLGLDIIKREYAALGMKSNFSLF DDTDQVALLKE  119
A0A085ITL8     A0A085ITL8_RAOPL  60  AREMKERVGQTLGRKEARGLMIST HTLGLDIIKREYAALGMKSNFSLF DDTDQVALLKE  119
E7T4Q1         E7T4Q1_SHIBO      60  AREMKERVGQTLGRKEARGLMIST HTLGLDIIKREYAALGMKVNFSLF DDTDQLALLKE  119
A0A085GMM2     A0A085GMM2_9ENTR  60  AREMKERVAQTLGRKEARGLLIST HTLGLEIIKREYAALGMKSNFSLF DDTDQTALLKD  119
A0A085HAK1     A0A085HAK1_9ENTR  41  AREMKERVAQTLGRKEARGLMIST HTLGLDIIKREYAALGMKSNFSLF DDTDQMALIKE  100
D4BE16         D4BE16_9ENTR      60  AREMKERVAQTLGRKEARGLMIST HTLGLDVIKREYAALGMKSNFSLF DDTDQVALLKE  119
A0A0H5PMJ7     A0A0H5PMJ7_SALSE  60  AREMKERVGQTLGRKEARGLMIST HTLGLDIIKREYAALGMKSNFSLF DDTDQVALLKE  119
A0A0J1JQT3     A0A0J1JQT3_CITFR  60  AREMKERMAQTLGRKEARGLMIST HTLGLDIIKREYAALGMKSNFSLF DDTDQVALLKE  119
A0A0J8VI05     A0A0J8VI05_9ENTR  60  AREMKERVAQTLGRKEARGLMIST HTLGLEIIKREYNALGMKANFSLF DDTDQMALIKE  119
F5S3F4         F5S3F4_9ENTR      60  AREMKERVGQTLGRKEARGLMIST HTLGLDIIKREYAALGMKSNFSLF DDTDQVALLKE  119
D2ZMA5         D2ZMA5_9ENTR      60  AREMKERVGQTLGRKEARGLMIST HTLGLDIIKREYAALGMKSNFSLF DDTDQVALLKE  119
A0A084ZTW9     A0A084ZTW9_9E     60  AREMKERVAQTLGRKEARGLMIST HTLGLEIIKREFAALGMKSNFSLF DDTDQVALLKE  119
A0A038CLT3     A0A038CLT3_RAOOR  60  AREMKERVAQTLGRKEARGLMIST HTLGLDIIKREYAALGMKSNFSLF DDTDQVALLKE  119
Q8Z385         Q8Z385_SALTI      60  AREMKERVGQTLGRKEARGLMIST HTLGLDIIKREYAALGMKSNFSLF DDTDQVALLKE  119
Q83IX8         Q83IX8_SHIFL      60  AREMKERVGQTLGRKEAHGLMIST HTLGLDIIKREYAALGMKANFSLF DDTDQLALLKE  119
A0A0D5WYP4     A0A0D5WYP4_9ENTR  60  AREMKERVSQTLGRKEARGLMIST HTLGLEIIKREYAALGMKSNFSLF DDTDQTALLKE  119
A0A0H3FM31     A0A0H3FM3         60  AREMKERVGQTLGRKEARGLMIST HTLGLDIIKREYAALGMKSNFSLF DDTDQVALLKE  119
A0A0H2WUK6     A0A0H2WUK6_SALPA  60  AREMKERVGQTLGRKEARGLMIST HTLGLDIIKREYAALGMKSNFSLF DDTDQVALLKE  119
A0A0H3H1F3     A0A0H3H1F3_KLEOK  60  AREMKERVGQTLGRKEARGLMIST HTLGLDIIKREYAALGMKSNFSLF DDTDQVALLKE  119
X7I146         X7I146_CITFR      60  AREMKERVAQTLGRKEARGLMIST HTLGLDIIKREYAALGMKSNFSLF DDTDQVALLKE  119
A0A0H3CTF5     A0A0H3CTF5_ENTCC  60  AREMKERVGQTLGRKEARGLMIST HTLGLDIIKREYAALGMKSNFSLF DDTDQVALLKE  119
D2TH67         D2TH67_CITRI      60  AREMKERVGQTLGRKEARGLMIST HTLGLEIIKREYAALGMKSNFSLF DDTDQLALLKE  119
Q329V6         Q329V6_SHIDS      60  AREMKERVGQTLGRKEARGLMIST HTLGLDIIKREYAALGMKANFSLF DDTDQLALLKE  119
W6J7C4         W6J7C4_9ENTR      60  AREMKERVAQTLGRKEARGLMIST HTLGLNIIKREFAALGMKSNFSLF DDTDQVALLKD  119
I2BE87         I2BE87_SHIBC      60  AREMKERVGQTLGRKEARGLMIST HTLGLEIIKREYAALGMKSNFSLF DDTDQLALIKD  119
B5EZ38         B5EZ38_SALA4      60  AREMKERVAQTLGRKEARGLMIST HTLGLDIIKREYAALGMKSNFSLF DDTDQVALLKE  119
A0A0F5SGU2     A0A0F5SGU         60  AREMKERVAQTLGRKEARGLMIST HTLGLDVIKREYAALGMKSNFSLF DDTDQVALLKE  119
G9YY11         G9YY11_9ENTR      60  AREMKERVGQTLGRKEARGLMIST HTLGLDIIKREYAALGMKSNFSLF DDTDQVALLKE  119
A0A090UXU3     A0A090UXU3_9ENTR  60  AREMKERVAQTLGRKEARGLMIST HTLGLDVIKREYAALGMKSNFSLF DDTDQVALLKE  119
A9MJ31         A9MJ31_SALAR      60  AREMKERVGQTLGRKEARGLMIST HTLGLDIIKREYAALGMKSNFSLF DDTDQVALLKE  119
Q3YVI6         Q3YVI6_SHISS      60  AREMKERVAQTLGRKEARGLMIST HTLGLDIIKREYAALGMKANFSLF DDTDQLALLKE  119
D3RHB6         D3RHB6_KLEVT      60  AREMKERVGQTLGRKEARGLMIST HTLGLDIIKREYAALGMKSNFSLF DDTDQVALLKE  119
Q57HT8         Q57HT8_SALCH      93  AREMKERVGQTLGRKEARGLMIST HTLGLDIIKREYAALGMKSNFSLF DDSDQVALLKE  152
B5RFS5         B5RFS5_SALG2      60  AREMKERVGQTLGRKEARGLMIST HTLGLDIIKREYAALGMKSNFSLF DDTDQVALLKE  119
A0A089Q204     A0A089Q204_9ENTR  60  AREMKERVSQTLGRKEARGLMIST HTLGLEIIKREYAALGMKSNFSLF DDTDQTALLKE  119
A0A0H3BNR1     A0A0H3BNR1_SALNS  60  AREMKERVAQTLGRKEARGLMIST HTLGLDIIKREYAALGMKSNFSLF DDTDQVALLKE  119
C9Y4T0         C9Y4T0_SICTZ      60  AREMKERVAQTMGRKEARGLMIST HTLGLEIIKREYVALGMKSNFSLF DDTDQMALIKE  119
B7LU77         B7LU77_ESCF3      60  AREMKERVGQTLGRKEARGLMIST HTLGLDIIKREYAALGMKSNFSLF DDTDQLALLKE  119
A0A0H3TAW8     A0A0H3TAW8_SALEN  60  AREMKERVGQTLGRKEARGLMIST HTLGLDIIKREYAALGMKSNFSLF DDTDQVALLKE  119
G2S5J6         G2S5J6_ENTAL      60  AREMKERVAQTLGRKEARGLMIST HTLGLDIIKREYAALGMKSNFSLF DDTDQVALLKE  119
A0A0F7JC30     A0A0F7JC30_SALET  60  AREMKERVAQTLGRKEARGLMIST HTLGLDIIKREYAALGMKSNFSLF DDTDQVALLKE  119
A7MQI4         A7MQI4_CROS8      60  AREMKERVAQTLGRKEARGLMIST HTLGLEIIKREYAALGMKSNFSLF DDTDQMALIKE  119
L0M8J0         L0M8J0_ENTBF      60  AREMKERVGQTLGRKEARGLMIST HTLGLDIIKREYAALGMKSNFSLF DDTDQVALLKD  119
A0A0K0HFU2     A0A0K0HFU2_SALBC  60  AREMKERVGQTLGRKEARGLMIST HTLGLEIIKREYAALGMKSNFSLF DDTDQTALLKE  119
A8ACT1         A8ACT1_CITK8      60  AREMKERVGQTLGRKEARGLMIST HTLGLDIIKREYAALGMKSNFSLF DDTDQVALLKE  119
```

```
                                                                                              Domain 1B
                                                                                              Target Residues
P09980         REP_ECOLI          120  LTEGL-IEDDKVLLQQLISTISNWKNDLKTPSQAAASAIGERDRIFAHCYGLYDAHLKACNVLDPDDLI 187
O51889         REP_BUCAP          120  ICSKS-IKNDTKLLKKLVFMISFWKNKFLTPLQVQLSAQSNLEKDFAFFYKQYTFHLRKS         178
P57654         REP_BUCAI          120  ICKKE-IKNNIQLLKKLNFMISYWKNKFLTPLQVQLLAKSSQEKDFAYVVEQYTNYLYKA         178
P44804         REP_HAEIN          120  LTADV-LKEDKDLLRELISVISNWKNDLISPKQAFALARDAKYQTFAKCYERYATQIRTV         178
Q9L6S1         REP_SALTY          120  LTEGL-IEDDKVLLQQLISTISNWKNDLKTPAAAAGAKGERDRIFAHCYGLYDAHMKAC         178
A0A077ZIR6     A0A077ZIR6_TRITR   137  LTEGL-IEDDKVLLQQLISTISNWKNDLKTPSQAAASAIGERDRIFAHCYGLYDAHLKAC         195
S3IEG5         S3IEG5_9EN         120  LTEGL-LENDKVLLQQLISTISNWKNSLLTPAQAAAQAKGERDRIFAHCYGLYDTHLKSC        178
J1R585         J1R585_9ENTR       120  LTEGL-IDDDKAVLQQLISTISNWKNDLLTPPQAAAQAKGERDRIFAHCYGLYDSHMKSC        178
K8ABZ8         K8ABZ8_9ENTR       101  LTEGL-IENDKVLLQQLISTISNWKNDLSPPQAAARAIGERERIFAHCYSLYDAHLKAC        159
A0A060VJ91     A0A060VJ91_KLEPN   181  LTEGL-IEDDKVVLQQLISTISNWKNDLKTPAQAAAGAKGERDRIFAHCYGLYDAHMKAC        239
A0A090V5M6     A0A090V5M6_ESCVU   120  LTEGL-IEDEKTILQQLISTISNWKNDLMTPAQAAAQARGERDRIFAHCYSLYDAHMKAC        178
A0A083YZC2     A0A083YZC2_CITAM   120  LTEGL-IEDDKVILQQLISTISNWKNDLKTPAQAAAGAKGERDRIFAHCYGLYDAHMKAC        178
A0A0J6D7T8     A0A0J6D7T8_SALDE   120  LTEGL-IEDDKVLLQQLISTISNWKNDLKTPAQAAAGAKGERDRIFAHCYGLYDAHMKAC        178
A0A085ITL8     A0A085ITL8_RAOPL   120  LTEGL-IDDDKVVLQQLISTISNWKNDLQTPAQAAAGAKGERERIFAHCYGLYDGHMKAC        178
E7T4Q1         E7T4Q1_SHIBO       120  LTEGL-IEDDKVLLQQLISTISNWKNDLKTPSQAAASAIGERDRIFAHCYGLYDAHLKAC        178
A0A085GMM2     A0A085GMM2_9ENTR   120  LTEGL-LEDDKTLLQQLISTISNWKNDLMSPSQAAAQAKGERDRIFAHCYGLYDTHLKSC       178
A0A085HAK1     A0A085HAK1_9ENTR   101  LTEGL-IEDDKTVLQQLISTISNWKNDLMNPEQAAASAKGERDRIFAHCYGLYNDHLKAC       159
D4BE16         D4BE16_9ENTR       120  LTEGL-IEDDKLILQQLISTISNWKNDLMTPAAAASAKGERDRIFAHCYGLYDAHMKAC        178
A0A0H5PMJ7     A0A0H5PMJ7_SALSE   120  LTEGL-IEDDKVLLQQLISTISNWKNDLKTPAQAAAGAKGERDRIFAHCYGLYDAHMKAC       178
A0A0J1JQT3     A0A0J1JQT3_CITFR   120  LTEGL-IEDDKLILQQLISTISNWKNDLMTPAQAAASAKGERDRIFAHCYGLYDAHMKAC       178
A0A0J8VI05     A0A0J8VI05_9ENTR   120  LTEGL-VENDKSLLQQLISTISNWKNDLLNPLQAAAQAKGERDRIFAHCYGLYDAHLKAC       178
F5S3F4         F5S3F4_9ENTR       120  LTEGL-IEDDKVLLQQLISTISNWKNDLMTPAQAAAGAKGERDRIFAHCYGLYDAHMKAC       178
D2ZMA5         D2ZMA5_9ENTR       120  LTEGL-IEDDKTVLQQLISTISNWKNDLMTPSQAAAIAKGERDRIFAHCYGLYDAHMKAC       178
A0A084ZTW9     A0A084ZTW9_9ENTR   120  LTEGL-IDDDKTLLQQLISTISNWKNDLLTPAQAAAQAKGERDRIFAHCYGLYDAHMKAC       178
A0A038CLT3     A0A038CLT3_RAOOR   120  LTEGL-IDDDKVVLQQLISTISNWKNDLQTPAQAAAGAKGERERIFAHCYGLYDGHMKAC       178
Q8Z385         Q8Z385_SALTI       120  LTEGL-IEDDKVLLQQLISTISNWKNDLKTPAQAAAGAKGERDRIFAHCYGLYDAHMKAC       178
Q83IX8         Q83IX8_SHIFL       120  LTEGL-IEDDKVLLQQLISTISNWKNDLKTPSQAAASAIGERDRIFAHCYGLYDAHLKAC       178
A0A0D5WYP4     A0A0D5WYP4_9ENTR   120  LTEGL-LENDKVLLQQLISTISNWKNGLLSPAQAAAQAKGERDRIFAHCYGLYDTHLKSC       178
A0A0H3FM31     A0A0H3FM31_ENTAK   120  LTEGL-IEDDKVVLQQLISTISNWKNDLKTPAQAAAGAKGERDRIFAHCYGLYDAHMKAC       178
A0A0H2WUK6     A0A0H2WUK6_SALPA   120  LTEGL-IEDDKVLLQQLISTISNWKNDLKTPAQAAAGAKGERDRIFAHCYGLYDAHMKAC       178
A0A0H3H1F3     A0A0H3H1F3_KLEOK   120  LTEGL-IEDDKVVLQQLISTISNWKNDLQTPAQAAAGAKGERDRIFAHCYGLYDAHMKAC       178
X7I146         X7I146_CITFR       120  LTEGL-IEDDKLILQQLISTISNWKNDLMTPAQAAASAKGERDRIFAHCYGLYDAHMKAC       178
A0A0H3CTF5     A0A0H3CTF5_ENTCC   120  LTEGL-IEDDKVLLQQLISTISNWKNDLMTPAAAASAKGERDRIFAHCYGLYDAHMKAC       178
D2TH67         D2TH67_CITRI       120  LTEGL-LEEDKVLLQQLISTISNWKNDLQTPAQAAAGAKGERDRIFAHCYGLYDAHLKAC       178
Q329V6         Q329V6_SHIDS       120  LTEGL-IEDDKVLLQQLISTISNWKNDLKTPAQAAAEAKGERDRIFAHCYGLYDAHMKAC       178
W6J7C4         W6J7C4_9ENTR       120  LTEGL-IDDDKVVLQQLISTISNWKNDLLTPPQAAARANGERDRIFAHCYGLYDAHMKAC       178
I2BE87         I2BE87_SHIBC       120  LTEGL-LENDKVIYQQLISTISNWKNDLMGPDQAAAMARGERDRIFAHCYRLYYDHLKAC       178
B5EZ38         B5EZ38_SALA4       120  LTEGL-IEDDKVLLQQLISTISNWKNDLKTPAQAAAGAKGERDRIFAHCYGLYDAHMKAC       178
A0A0F5SGU2     A0A0F5SGU2_CITAM   120  LTEGL-IEDDKLILQQLISTISNWKNDLMTPAQAAASAKGERDRIFAHCYGLYDAHMKAC       178
G9YY11         G9YY11_9ENTR       120  LTEGL-LEDDKVLLQQLISTISNWKNDLMTPAQAAAQAKGERDRIFAHCYSLYDAHMKAC       178
A0A090UXU3     A0A090UXU3_9ENTR   120  LTEGL-IEDDKLILQQLISTISNWKNDLMTPAQAAASAKGERDRIFAHCYGLYDAHMKAC       178
A9MJ31         A9MJ31_SALAR       120  LTEGL-IDDDKVVLQQLISTISNWKNDLKTPAQAAAGAKGERDRIFAHCYGLYDAHMKAC       178
Q3YVI6         Q3YVI6_SHISS       120  LTEGL-IEDDKVLLQQLISTISNWKNDLKTPSQAAASAIGERDRIFAHCYGLYDAHLKAC       178
D3RHB6         D3RHB6_KLEVT       120  LTEGL-IEDDKVVLQQLISTISNWKNDLKTPAQAAAGAKGERDRIFAHCYGLYDAHMKAC       178
Q57HT8         Q57HT8_SALCH       153  LTEGL-IEDDKVLLQQLISTISNWKNDLKTPAQAAAGAKGERDRIFAHCYGLYDAHMKAC       211
B5RFS5         B5RFS5_SALG2       120  LTEGL-IEDDKVLLQQLISTISNWKNDLKTPAQAAAGAKGERDRIFAHCYGLYDAHMKAC       178
A0A089         A0A089Q204_9ENTR   120  LTEGL-LENDKVLLQQLISTISNWKNGLLSPAQAAAQAKGERDRIFAHCYGLYDTHLKSC       178
A0A0H3BNR1     A0A0H3BNR1_SALNS   120  LTEGL-IEDDKVLLQQLISTISNWKNDLKTPAQAAAGAKGERDRIFAHCYGLYDAHMKAC       178
C9Y4T0         C9Y4T0_SICTZ       120  LTEGL-VENDKVLLQQLISTISNWKNDLLSPPQAAARAIGERERIFAHCYSLYDAHLKAC      178
B7LU77         B7LU77_ESCF3       120  LTEGL-IEDDKVLLQQLISTISNWKNDLKTPAQAAAEAKGERDRIFAHCYGLYDSHLKAC       178
A0A0H3TAW8     A0A0H3TAW8_SALEN   120  LTEGL-IEDDKVVLQQLISTISNWKNDLKTPAQAAAGAKGERDRIFAHCYGLYDAHMKAC       178
G2S5J6         G2S5J6_ENTAL       120  LTEGL-IEDDKVLLQQLISTISNWKNDLMTPAQAAASAKGERDRIFAHCYSLYDAHMKAC       178
A0A0F7JC30     A0A0F7JC30_SALET   120  LTEGL-IEDDKVLLQQLISTISNWKNDLKTPAQAAAGAKGERDRIFAHCYGLYDAHMKAC       178
A7MQI4         A7MQI4_CROS8       120  LTEGL-VENDKVLLQQLISTISNWKNDLLSPPQAAARAIGERERIFAHCYSLYDAHLKAC      178
L0M8J0         L0M8J0_ENTBF       120  LTEGL-IEDDKVQLQQLISTISNWKNDLKSPAQAAAGAKGERDRIFAHCYGLYDAHMKAC       178
A0A0K0HFU2     A0A0K0HFU2_SALBC   120  LTEGL-IEDDKILLQQLISTISNWKNDLKTPAQAAASAKGERDRIFAHCYGLYDAHMKAC       178
A8ACT1         A8ACT1_CITK8       120  LTDGL-IEDDKVILQQLISTISNWKNDLMTPAQAAASAKGERDRIFAHCYGLYDAHLKAC       178
```

Domain 2B
Target Residues

| | | | | |
|---|---|---|---|---|
| P09980 | REP_ECOLI | 359 | EKFLMQNRIPYKISGGTSFFSRPEIKDLLAYLRVLTNPDDDSAFLRIVNTPKREIGPATL | 418 |
| O51889 | REP_BUCAP | 359 | EKTFLKKNIPYDISTNSSFFSRPEIKDLLSYLRLIVNPDDNHAFIRILNIPHRQIGLTTL | 418 |
| P57654 | REP_BUCAI | 359 | EKALIKENIPYNISEKSSFFSRPEIKDLLSYLRVVINRDDNHAFMRIVNIPSRQIGKTTL | 418 |
| P44804 | REP_HAEIN | 359 | EKVLMQNRIPYKISGGTSFFSRAEIKDMMAYLRLVVNQDDDAAFLRIVNTPKREIGTATL | 418 |
| Q9L6S1 | REP_SALTY | 359 | EKFLMQNRIPYKISGGTSFFSRPEIKDLLAYLRVLTNPDDDSAFLRIVNTPKREIGPATL | 418 |
| A0A077ZIR6 | A0A077ZIR6_TRITR | 376 | EKFLMQNRIPYKISGGTSFFSRPEIKDLLAYLRVLTNPDDDSAFLRIVNTPKREIGPATL | 435 |
| S3IEG5 | S3IEG5_9ENTR | 359 | EKMLMQNRIPYHISGGTSFFSRPEIKDLLAYLRVLTNPDDDSAFLRIVNTPKREIGPATL | 418 |
| J1R585 | J1R585_9ENTR | 359 | EKFLMQNRIPYKISGGTSFFSRPEIKDLLAYLRVLTNTEDDSAFLRIVNTPKREIGSATL | 418 |
| K8ABZ8 | K8ABZ8_9ENTR | 340 | EKMLMQNRIPYRISGGTSFFSRPEIKDLLAYLRVLTNPDDDSAFLRIVNTPKREIGPATL | 399 |
| A0A060VJ9 | A0A060VJ91_KLEPN | 420 | EKMLMQNRIPYKISGGTSFFSRPEIKDLLAYLRVLTNPDDDSAFLRIVNTPKREIGPATL | 479 |
| A0A090V5M6 | A0A090V5M6_ESCVU | 359 | EKFLMQNRIPYRISGGTSFFSRPEIKDLLAYLRVLTNPDDDSAFLRIVNTPKREIGPATL | 418 |
| A0A083YZC2 | A0A083YZC2_CITAM | 359 | EKFLMQNRIPYKISGGTSFFSRPEIKDLLAYLRVLTNPDDDSAFLRIVNTPKREIGPATL | 418 |
| A0A0I6D7T8 | A0A0I6D7T8_SALDE | 359 | EKFLMQNRIPYKISGGTSFFSRLEIKDLLAYLRVLTNPDDDSAFLRIVNTPKREIGPATL | 418 |
| A0A085ITL8 | A0A085ITL8_RAOPL | 359 | EKMLMQNRIPYKISGGTSFFSRPEIKDLLAYLRVLTNPDDDSAFLRIVNTPKREIGPATL | 418 |
| E7T4Q1 | E7T4Q1_SHIBO | 359 | EKFLMQNRIPYKISGGTSFFSRPEIKDLLAYLRVLTNPDDDSAFLRIVNTPKREIGPATL | 418 |
| A0A085GMM2 | A0A085GMM2_9ENTR | 359 | EKMLMQNRIPYKISGGTSFFSRPEIKDLLAYLRVLTNPDDDSAFMRIVNTPKREIGSATL | 418 |
| A0A085HAK1 | A0A085HAK1_9ENTR | 340 | EKMLMQNRIPYKISGGTSFFSRPEIKDLLAYLRVLTNPDDDSAFLRIVNTPKREIGPATL | 399 |
| D4BE16 | D4BE16_9ENTR | 359 | EKFLMQNRIPYKISGGTSFFSRPEIKDLLAYLRVLSNPDDDSAFLRIVNTPKREIGSATL | 418 |
| A0A0H5PMJ7 | A0A0H5PMJ7_SALSE | 359 | EKFLMQNRIPYKISGGTSFFSRPEIKDLLAYLRVLTNPDDDSAFLRIVNTPKREIGPATL | 418 |
| A0A0J1JQT3 | A0A0J1JQT3_CITFR | 359 | EKFLMQNRIPYKISGGTSFFSRPEIKDLLAYLRVLSNPDDDSAFLRIVNTPKREIGPATL | 418 |
| A0A0J8VI05 | A0A0J8VI05_9ENTR | 359 | BKLLMQNRIPYKISGGTSFFSRPEIKDLLAYLRVLTNPDDDSAFLRIVNTPKREIGPATL | 418 |
| F5S3F4 | F5S3F4_9ENTR | 359 | EKMLMQNRIPYKISGGTSFFSRPEIKDLLAYLRVLTNPDDDSAFLRIVNTPKREIGSATL | 418 |
| D2ZMA5 | D2ZMA5_9ENTR | 359 | EKMLMQNRIPYKISGGTSFFSRPEIKDLLAYLRVLTNPDDDSAFLRIVNTPKREIGPATL | 418 |
| A0A084ZTW9 | A0A084ZTW9_9ENTR | 359 | EKMLMQNRIPYKISGGTSFFSRPEIKDLLAYLRVLTNPDDDSAFLRIVNTPKREIGPATL | 418 |
| A0A038CLT3 | A0A038CLT3_RAOOR | 359 | EKMLMQNRIPYKISGGTSFFSRPEIKDLLAYLRVLTNPDDDSAFLRIVNTPKREIGPATL | 418 |
| Q8Z385 | Q8Z385_SALTI | 359 | EKFLMQNRIPYKISGGTSFFSRPEIKDLLAYLRVLTNPDDDSAFLRIVNTPKREIGPATL | 418 |
| Q83IX8 | Q83IX8_SHIFL | 359 | EKFLMQNRIPYKISGGTSFFSRPEIKDLLAYLRVLTNPDDDSAFLRIVNTPKREIGPATL | 418 |
| A0A0D5WYP4 | A0A0D5WYP4_9ENTR | 359 | EKMLMQNRIPYRISGGTSFFSRPEIKDLLAYLRVLTNPDDDSAFLRIVNTPKREIGPATL | 418 |
| A0A0H3FM31 | A0A0H3FM31_ENTAK | 359 | EKMLMQNRIPYKISGGTSFFSRPEIKDLLAYLRVLTNPDDDSAFLRIVNTPKREIGPATL | 418 |
| A0A0H2WUK6 | A0A0H2WUK6_SALPA | 359 | EKFLMQNRIPYKISGGTSFFSRPEIKDLLAYLRVLTNPDDDSAFLRIVNTPKREIGPATL | 418 |
| A0A0H3H1F3 | A0A0H3H1F3_KLEOK | 359 | EKMLMQNRIPYKISGGTSFFSRPEIKDLLAYLRVLTNPDDDSAFMRIVNTPKREIGSATL | 418 |
| X7I146 | X7I146_CITFR | 359 | EKFLMQNRIPYKISGGTSFFSRPEIKDLLAYLRVLSNPDDDSAFLRIVNTPKREIGPATL | 418 |
| A0A0H3CTF5 | A0A0H3CTF5_ENTCC | 359 | EKMLMQNRIPYKISGGTSFFSRPEIKDLLAYLRVLTNPDDDSAFLRIVNTPKREIGPATL | 418 |
| D2TH67 | D2TH67_CITRI | 359 | EKFLMQNRIPYKISGGTSFFSRPEIKDLLAYLRVLTNPDDDSAFLRIVNTPKREIGPATL | 418 |
| Q329V6 | Q329V6_SHIDS | 359 | EKFLMQNRIPYKISGGTSFFSRPEIKDLLAYLRVLTNPDDDSAFLRIVNTPKREIGPATL | 418 |
| W6J7C4 | W6J7C4_9ENTR | 359 | EKFLMQNRIPYKISGGTSFFSRPEIKDLLAYLRVLTNTDDDSAFLRIVNTPKREIGSATL | 418 |
| I2BE87 | I2BE87_SHIBC | 359 | EKMLMQNRIPYRISGGTSFFSRPEIKDLLAYLRVLTNPDDDSAFLRIVNTPRREIGPATL | 418 |
| B5EZ38 | B5EZ38_SALA4 | 359 | EKFLMQNRIPYKISGGTSFFSRPEIKDLLAYLRVLTNPDDDSAFLRIVNTPKREIGPATL | 418 |
| A0A0F5SGU2 | A0A0F5SGU2_CITAM | 359 | EKFLMQNRIPYKISGGTSFFSRPEIKDLLAYLRVLSNPDDDSAFLRIVNTPKREIGPATL | 418 |
| G9YY11 | G9YY11_9ENTR | 359 | EKMLMQNRIPYKISGGTSFFSRPEIKDLLAYLRVLSNPDDDSAFLRIVNTPKREIGPATL | 418 |
| A0A090UXU3 | A0A090UXU3_9ENTR | 359 | EKMLMQNRIPYKISGGTSFFSRPEIKDLLAYLRVLSNPDDDSAFLRIVNTPKREIGPATL | 418 |
| A9MJ31 | A9MJ31_SALAR | 359 | EKFLMQNRIPYKISGGTSFFSRPEIKDLLAYLRVLTNPDDDSAFLRIVNTPKREIGSATL | 418 |
| Q3YVI6 | Q3YVI6_SHISS | 359 | EKFLMQNRIPYKISGGTSFFSRPEIKDLLAYLRVLTNPDDDSAFLRIVNTPKREIGPATL | 418 |
| D3RHB6 | D3RHB6_KLEVT | 359 | EKMLMQNRIPYKISGGTSFFSRPEIKDLLAYLRVLTNPDDDSAFLRIVNTPKREIGPATL | 418 |
| Q57HT8 | Q57HT8_SALCH | 392 | EKFLMQNRIPYKISGGTSFFSRPEIKDLLAYLRVLTNPDDDSAFLRIVNTPKREIGPATL | 451 |
| B5RFS5 | B5RFS5_SALG2 | 359 | EKFLMQNRIPYKISGGTSFFSRPEIKDLLAYLRVLTNPDDDSAFLRINIPKREIGPATL | 41 |
| A0A089Q204 | A0A089Q204_9ENTR | 359 | EKMLMQNRIPYKISGGTSFFSRPEIKDLLAYLRVLTNPDDDSAFLRIVNTPKREIGPATL | 418 |
| A0A0H3BNR1 | A0A0H3BNR1_SALNS | 359 | EKFLMQNRIPYKISGGTSFFSRPEIKDLLAYLRVLTNPDDDSAFLRIVNTPKREIGPATL | 418 |
| C9Y4T0 | C9Y4T0_SICTZ | 359 | EKFLMQNRIPYKISGGTSFFSRPEIKDLLAYLRVLTNPDDDSAFLRIVNTPKREIGPATL | 418 |
| B7LU77 | B7LU77_ESCF3 | 359 | EKFLMQNRIPYKISGGTSFFSRPEIKDLLAYLRVLTNPDDDSAFLRIVNTPKREIGPATL | 418 |
| A0A0H3TAW8 | A0A0H3TAW8_SALEN | 359 | EKFLMQNRIPYKISGGTSFFSRPEIKDLLAYLRVLTNPDDDSAFLRIVNTPKREIGPATL | 418 |
| G2S5J6 | G2S5J6_ENTAL | 359 | EKMLMQNRIPYKISGGTSFFSRPEIKDLLAYLRVLTNPDDDSAFLRIVNTPKREIGPATL | 418 |
| A0A0F7JC30 | A0A0F7JC30_SALET | 359 | EKFLMQNRIPYKISGGTSFFSRPEIKDLLAYLRVLTNPDDDSAFLRIVNTPKREIGPATL | 418 |
| A7MQI4 | A7MQI4_CROS8 | 359 | EKMLMQNRIPYKISGGTSFFSRPEIKDLLAYLRVLTNPDDDSAFLRIVNTPKREIGPATL | 418 |
| L0M8J0 | L0M8J0_ENTBF | 359 | EKFLMQNRIPYKISGGTSFFSRPEIKDLLAYLRVLTNPDDDSAFLRIVNTPKREIGAATM | 418 |
| A0A0K0HFU2 | A0A0K0HFU2_SALBC | 359 | EKFLMQNRIPYKISGGTSFFSRPEIKDLLAYLRVLTNPDDDSAFLRIVNTPKREIGPATL | 418 |
| A8ACT1 | A8ACT1_CITKS | 359 | EKFLMQNRIPYKISGGTSFFSRPEIKDLLAYLRVLTNPDDDSAFLRIVNTPKREIGPATL | 418 |

*Fig. 9D*

Domain 2B Target Residues

| ID | Name | Start | Sequence | End |
|---|---|---|---|---|
| P09980 | REP_ECOLI | 419 | KKLGEWAMTRNKSMFTASFDMGLSQTLSGRGYEALTRFTHWLAEIQRLAEREPIAAVRD | 477 |
| O51889 | REP_BUCAP | 419 | NKLEELASKKNKSLFQISNDIEIKKILRERTVKKIKDFIYWIKKIIK--LSLLKEDIILDK | 477 |
| P57654 | REP_BUCAI | 419 | KKLEEWANKKHVSLFQASNNIEIKKFLNENTIKKIKNFISKIEKFTA-WSCLKPSNIIDD | 477 |
| P44804 | REP_HAEIN | 419 | QKLGELAQEKHISLFEAIFEFELIQRITPKAYDSLQKFGRWIVELNDEIQRSEPERAVRS | 478 |
| Q9L6S1 | REP_SALTY | 419 | QKLGEWAMTRNKSLFTASFDMGLSQKLTGRGYDSLTRFTHWLGEIQR-LAEREPVAAVRD | 477 |
| A0A077ZIR6 | A0A077ZIR6_TRITR | 436 | KKLGEWAMTRNKSMFTASFDMGLSQTLSGRGYEALTRFTHWLAEIQR-LAEREPIAAVRD | 494 |
| S3IEG5 | S3IEG5_9ENTR | 419 | QKLGEWATQRNKSLLTASFDMGLSQTLSGRGLESLQRFTHWLREVAT-LAEREPVAAVRD | 477 |
| J1R585 | J1R585_9ENTR | 419 | QKLGEWAMLRNKSLFAASFDVGLNQTLTGRGYESLTRFTQWLGDVQQ-LSEREPIAAVRD | 477 |
| K8ABZ8 | K8ABZ8_9ENTR | 400 | QKLGEWATQRNKSLFTASFDMGLSQSLTGRGYESLTRFTQWLQEVAV-LSEREPVAAVRD | 458 |
| A0A060VJ91 | A0A060VJ91_KLEPN | 480 | QKLGEWAMGRNKGLFTASFDMGLSQTLTGRGYESLTRFTHWLREIQQ-LAEREPVNAVRD | 538 |
| A0A090V5M6 | A0A090V5M6_ESCVU | 419 | QKLGEWANSRNKGLFAASFDMGLTQTLSGRGYESLTRFTHWLSEVQR-LSEREPVAAVRD | 477 |
| A0A083YZC2 | A0A083YZC2_CITAM | 419 | QKLGEWAMTRNKSLFTASFDLGLSQTLTGRGYDSLTRFTHWLGEVQR-LAEREPIAAVRD | 477 |
| A0A0J6D7T8 | A0A0J6D7T8_SALDE | 419 | QKLGEWAMTRNKSLFTASFDMGLSQKLTGRGYDSLTRFTHWLGEIQR-LAEREPVAAVRD | 477 |
| A0A085ITL8 | A0A085ITL8_RAOPL | 419 | QKLGEWAMTRNKSLFTASFDMGLNQTLTGRGYDALTGFTQWLADIQR-LAEREPVAAVRD | 477 |
| E7T4Q1 | E7T4Q1_SHIBO | 419 | KKLGEWAMTRNKSMFTASFDMGLSQTLSGRGYEALTRFTHWLAEIQR-LAEREPIAAVRD | 477 |
| A0A085GMM2 | A0A085GMM2_9ENTR | 419 | QKLGAWAMQRNKGLFLSSFDMGLSQTLSGRGLESLQRFTHWLREVAT-LAEREPIAAVRD | 477 |
| A0A085HAK1 | A0A085HAK1_9ENTR | 400 | QKLGEWAMTRNKSLLTASFDMGLSHTLTGRGYESLTRFTHWLREIQQ-LSEREPIAAVRD | 458 |
| D4BE16 | D4BE16_9ENTR | 419 | QKLGEWAMTRNKSLFTASFDMGLSQTLTGRGYDSLTRFTHWLGEIQR-LAEREPVAAVRD | 477 |
| A0A0H5PMJ7 | A0A0H5PMJ7_SALSE | 419 | QKLGEWAMTRNKSLFTASFDMGLSQKLTGRGYDSLTRFTHWLGEIQR-LAEREPVAAVRD | 477 |
| A0A0J1JQT3 | A0A0J1JQT3_CITFR | 419 | QKLGEWAMTRNKSLFTASFDMGLSQTLTGRGYDSLTRFTHWLGEIQR-LAEREPVAAVRD | 477 |
| A0A0J8VI05 | A0A0J8VI05_9ENTR | 419 | QKLGEWAMSRNKSLFTASFDMGLSQTLSGRGYESLTRFTHWLGEVAR-LSEREPVAAVRD | 477 |
| F5S3F4 | F5S3F4_9ENTR | 419 | QKLGEWAMTRNKSLFTASFDMGLSQTLTGRGYDALTRFTHWLGEVQR-LAEREPVAAVRD | 477 |
| D2ZMA5 | D2ZMA5_9ENTR | 419 | QKLGEWAMTRSKSMFTASFDMGLSQTLTGRGYDNLTRFTHWLGEVQR-LAEREPVAAVRD | 477 |
| A0A084ZTW9 | A0A084ZTW9_9ENTR | 419 | QKLGEWASTRNKSLFTASFDVGLTQTLSGRGYDALTRFTHWLGEIQR-LSEREPVAAVRD | 477 |
| A0A038CLT3 | A0A038CLT3_RAOOR | 419 | QKLGEWAMTRNKSLFTASFDMGLNQTLTGRGYDALTGFTQWLADIQR-LAEREPVAAVRD | 477 |
| Q8Z385 | Q8Z385_SALTI | 419 | QKLGEWAMTRNKSLFTASFDMGLSQKLTGRGYDSLTRFTHWLGEIQR-LAEREPVAAVRD | 477 |
| Q83IX8 | Q83IX8_SHIFL | 419 | KKLGEWAMTRNKSMFTASFDMGLSQTLSGRGYEALTRFTHWLAEIQR-LAEREPIAAVRD | 477 |
| A0A0D5WYP4 | A0A0D5WYP4_9ENTR | 419 | QKLGEWAMQRNKGLFTASFDMGLSQTLSGRGLDALQRFTHWLRDVAT-LAEREPVAAVRD | 477 |
| A0A0H3FM31 | A0A0H3FM31_ENTAK | 419 | QKLGEWAMSRNKGLFTASFDMGLSQTLTGRGYESLTRFTHWLREIQQ-LAEREPVNAVRD | 477 |
| A0A0H2WUK6 | A0A0H2WUK6_SALPA | 419 | QKLGEWAMTRNKSLFTASFDMGLSQKLTGRGYDSLTRFTHWLGEIQR-LAEREPVAAVRD | 477 |
| A0A0H3H1F3 | A0A0H3H1F3_KLEOK | 419 | KKLGEWAMGRNKSMFTASFDMGLTQTLNGRGYESLTRFTHWLREIQQ-LSEREPIAAVRD | 477 |
| X7I146 | X7I146_CITFR | 419 | QKLGEWAMTRNKSLFTASFDMGLSQTLTGRGYDSLTRFTHWLGEIQR-LAEREPVAAVRD | 477 |
| A0A0H3CTF5 | A0A0H3CTF5_ENTCC | 419 | QKLGEWAMTRNKSLFTASFDMGLSQTLTGRGYDSLTRFTHWLGEVQR-LAEREPVAAVRD | 477 |
| D2TH67 | D2TH67_CITRI | 419 | QKLGEWAMTRNKSLFTASFDLGLAQTLTGRGYESLTRFTHWLGEVQR-LAEREPVAAVRD | 477 |
| Q329V6 | Q329V6_SHIDS | 419 | KKLGEWAMTRNKSMFTASFDMGLSQTLSGRGYEALTRFTHWLAEIQR-LAEREPIAAVRD | 477 |
| W6J7C4 | W6J7C4_9ENTR | 419 | QKLGEWAMLRNKSLFAASFDVGLNQTLTGRGYDALTRFTHWLGEVQR-LAEREPVAAVRD | 477 |
| I2BE87 | I2BE87_SHIBC | 419 | QKLGEWALQRNKSMFTASFDLGLSQTLTGRGYEALTRFTHWLGEVAR-LSEKEPVAAVRD | 477 |
| B5EZ38 | B5EZ38_SALA4 | 419 | QKLGEWAMTRNKSLFTASFDMGLSQKLTGRGYDSLTRFTHWLGEIQR-LAEREPVAAVRD | 477 |
| A0A0F5SGU2 | A0A0F5SGU2_CITAM | 419 | QKLGEWAMTRNKSLFTASFDMGLSQTLTGRGYDSLTRFTHWLGDIQR-LAEREPVAAVRD | 477 |
| G9YY11 | G9YY11_9ENTR | 419 | QKLGEWAMTRSKSMFTASFDMGLSHLLPGRGYESLTRFTHWLGEVQR-LSEREPVAAVRD | 477 |
| A0A090UXU3 | A0A090UXU3_9ENTR | 419 | QKLGEWAMTRNKSLFTASFDMGLSQTLTGRGYDSLTRFTHWLGEIQR-LAEREPVAAVRD | 477 |
| A9MJ31 | A9MJ31_SALAR | 419 | QKLGEWAMTRNKSLFTASFDMGLSQTLTGRGYDSLTRFTHWLGEIQR-LAEREPVAAVRD | 477 |
| Q3YVI6 | Q3YVI6_SHISS | 419 | KKLGEWAMTRNKSMFTASFDMGLSQTLSGRGYEALTRFTHWLAEIQR-LAEREPIAAVRD | 477 |
| D3RHB6 | D3RHB6_KLEVT | 419 | QKLGEWAMGRNKGLFTASFDMGLSQTLTGRGYESLTRFTHWLREIQQ-LAEREPVNAVRD | 477 |
| Q57HT8 | Q57HT8_SALCH | 452 | QKLGEWAMTRNKSLFTASFDMGLSQKLTGRGYDSLTRFTHWLGEIQR-LAEREPVAAVRD | 510 |
| B5RFS5 | B5RFS5_SALG2 | 419 | QKLGEWAMTRNKSLFTASFDMGLSQKLTGRGYDSLTRFTHWLGEIQR-LAEREPVAAVRD | 477 |
| A0A089Q204 | A0A089Q204_9ENTR | 419 | QKLGEWAMQRNKGLFTASFDMGLSQTLSGRGLDSLQRFTHWLRDVAT-LAEREPVAAVRD | 477 |
| A0A0H3BNR1 | A0A0H3BNR1_SALNS | 419 | QKLGEWAMTRNKSLFTASFDMGLSQKLTGRGYDSLTRFTHWLGEIQR-LAEREPVAAVRD | 477 |
| C9Y4T0 | C9Y4T0_SICTZ | 419 | QKLGEWANQRNKSLFTASFDMGLAQTLSGRGYESLTRFTSWLQDVAV-LSEREPVAAVRD | 477 |
| B7LU77 | B7LU77_ESCF3 | 419 | KKLGEWAMTRNKSMFTASFDMGLSQTLSGRGYEALTRFTHWLAEIQR-LAEREPIAAVRD | 477 |
| A0A0H3TAW8 | A0A0H3TAW8_SALEN | 419 | QKLGEWAMTRNKSLFTASFDMGLSQKLTGRGYDSLTRFTHWLGEIQR-LAEREPVAAVRD | 477 |
| G2S5J6 | G2S5J6_ENTAL | 419 | QKLGEWAMTRNKSLFTASFDMGLSQTLTGRGYDSLTRFTHWLGEVQR-LAEREPVAAVRD | 477 |
| A0A0F7JC30 | A0A0F7JC30_SALET | 419 | QKLGEWAMTRNKSLFTASFDMGLSQKLTGRGYDSLTRFTHWLGEIQR-LAEREPVAAVRD | 477 |
| A7MQI4 | A7MQI4_CROS8 | 419 | QKLGEWANQRNKSLFTASFDMGLAQTLSGRGYESLTRFTSWLQEVAV-LSEREPVAAVRD | 477 |
| L0M8J0 | L0M8J0_ENTBF | 419 | QKLGEWAMTRNKSLFAASFDMGLTQTLTGRGYESLTRFTQWLAEVQR-LSEREPVAAVRD | 477 |
| A0A0K0HFU2 | A0A0K0HFU2_SALBC | 419 | QKLGEWAMTRSKSLFTASFDMGLSQTLTGRGYDALTRFTHWLAEIQR-LAEREPVAAVRD | 477 |
| A8ACT1 | A8ACT1_CITK8 | 419 | QKLGEWAMTRNKSLFTASFDVGLNQTLTGRGYDSLTRFTHWLGEIQR-LSEREPIAAVRD | 477 |

*Fig. 9E*

Domain 2B Target Residues

| Accession | Name | Start | Sequence | End |
|---|---|---|---|---|
| P09980 | REP_ECOLI | 478 | LIHGMDYESWLYETSPSPKAAEMRMKNVNQLFSWMTEMLEGSELDEPMTLTQVVTRFTLR | 537 |
| O51889 | REP_BUCAP | 478 | IINDIKYELWLTKILKEPKKIKTSINNIYTLSNWLKEMLRQNEFEKPMNLLQIVKKMTLR | 537 |
| P57654 | REP_BUCAI | 478 | IVDDLEYEKWLSKFLKDPNKIKNSINNVHTLSQWFKNMIKGDDFFEKPMTLFQIVTRMTLR | 537 |
| P44804 | REP_HAEIN | 479 | MLSAIHYEEYLYEYATSPKAAEMQSKNVATLFDWVADMLKGDETNEPMNLNQVVTRLTLR | 538 |
| Q9L6S1 | REP_SALTY | 478 | LIHGIDYESWLYETSPSPKAAEMRMKNVNQLFSWMTEMLEGNELDEPMTLTQVVTRFTLR | 537 |
| A0A077ZIR6 | A0A077ZIR6_TRITR | 495 | LIHGMDYESWLYETSPSPKAAEMRMKNVNQLFSWMTEMLEGSELDEPMTLTQVVTRFTLR | 554 |
| S3IEG5 | S3IEG5_9ENTR | 478 | LIHGIDYESWLYETSPSPKAAEMRMKNVNQLFSWMTEMLEASDLDEPMTLVQVVTRFTLR | 537 |
| J1R585 | J1R585_9ENTR | 478 | LIHGIDYESWLFETSPSPKAAEMRMKNVNTLFGWMTEMLEGSELDEPMTLAEVVTRFTLR | 537 |
| K8ABZ8 | K8ABZ8_9ENTR | 459 | LIRGIDYEAWLFETSPSPKAAEMRMKNVNQLFSWMTEMLEGTDLDEPMTLTQVVTRFTLR | 518 |
| A0A060VJ91 | A0A060VJ91_KLEPN | 539 | LIRGIDYESWLYETSPSPKAAEMRMKNVNQLFTWMTEMLEGSEIDEPMTLTQVVTRFTLR | 598 |
| A0A090V5M6 | A0A090V5M6_ESCVU | 478 | LIHGIDYESWLFETSPSPKAAEMRMKNVNTLFSWMTEMLEGSEIDEPMTLTQVVTRFTLR | 537 |
| A0A083YZC2 | A0A083YZC2_CITAM | 478 | LIHGIDYESWLYETSPSPKAAEMRMKNVNQLFSWMTEMLEGSELDEPMTLTQVVSRFTLR | 537 |
| A0A0J6D7T8 | A0A0J6D7T8_SALDE | 478 | LIHGIDYESWLYETSPSPKAAEMRMKNVNQLFSWMTEMLEGNELDEPMTLTQVVTRFTLR | 537 |
| A0A085ITL8 | A0A085ITL8_RAOP | 478 | LIRGVDYESWLYETSPSPKAAEMRMKNVNQLFSWMTEMLEGSDIDEPMTLTQVVTRFTLR | 537 |
| E7T4Q1 | E7T4Q1_SHIBO | 478 | LIHGMDYEFWLYETSPSPKAAEMRMKNVNQLFSWMTEMLEGSELDEPMTLTQVVTRFTLR | 537 |
| A0A085GMM2 | A0A085GMM2_9ENTR | 478 | LIHGIDYESWLYETSPSQKAAEMRMKNVNTLFSWMTEMLEGSEIDEPMTLTQVVTRFTLR | 537 |
| A0A085HAK1 | A0A085HAK1_9ENTR | 459 | LIRGIDYESWLYETSASPKAAEMRMKNVNQLFSWMTEMLEGSDIDEPMTLTQVVTRFTLR | 518 |
| D4BE16 | D4BE16_9ENTR | 478 | LIHGIDYESWLYETSPSPKAAEMRMKNVNTLFGWMTEMLEGSELEEPMTLTQVVTRFTLR | 537 |
| A0A0H5PMJ7 | A0A0H5PMJ7_SALSE | 478 | LIHGIDYESWLYETSPSPKAAEMRMKNVNQLFSWMTEMLEGNELDEPMTLTQVVTRFTLR | 537 |
| A0A0J1JQT3 | A0A0J1JQT3_CITFR | 478 | LIHGIDYESWLYETSPSPKAAEMRMKNVNTLFSWMTEMLEGSELEEPMTLTQVVTRFTLR | 537 |
| A0A0J8VI05 | A0A0J8VI05_9ENTR | 478 | LIHGIDYEAWLYETSPSQKAAEMRMKNVNQLFSWMTEMLEGTELDEPMTLTQVVTRFTLR | 537 |
| F5S3F4 | F5S3F4_9ENTR | 478 | LIHGIDYESWLYETSASPKAAEMRMKNVNQLFSWMTEMLEGSEIDEPMTLTQVVTRFTLR | 537 |
| D2ZMA5 | D2ZMA5_9ENTR | 478 | LIHGIDYESWLYETSASPKAAEMRMKNVNQLFSWMTEMLEGSEIDEPMTLTQVVTRFTLR | 537 |
| A0A084ZTW9 | A0A084ZTW9_9ENTR | 478 | LIHGIDYESWLFETSPSPKAAEMRMKNVNQLFSWMTEMLEGSELDEPMTLTQVVTRFTLR | 537 |
| A0A038CLT3 | A0A038CLT3_RAOOR | 478 | LIRGVDYESWLYETSPSPKAAEMRMKNVNQLFSWMTEMLEGSDIDEPMTLTQVVTRFTLR | 537 |
| Q8Z385 | Q8Z385_SALTI | 478 | LIHGIDYESWLYETSPSPKAAEMRMKNVNQLFSWMTEMLEQNELDEPMTLTQVVTRFTLR | 537 |
| Q83IX8 | Q83IX8_SHIFL | 478 | LIHGMDYESWLYETSPSTKAAEMRMKNVNQLFSWMTEMLEGSELDEPMTLTQVVTRFTLR | 537 |
| A0A0D5WYP4 | A0A0D5WYP4_9ENTR | 478 | LIHGIDYESWLYETSPSPKAAEMRMKNVNQLFSWMTEMLEGSDLDEPMTLTQVVTRFTLR | 537 |
| A0A0H3FM31 | A0A0H3FM31_ENTAK | 478 | LIRGIDYESWLYETSPSPKAAEMRMKNVNQLFTWMTEMLEGSEIDEPMTLTQVVTRFTLR | 537 |
| A0A0H2WUK6 | A0A0H2WUK6_SALPA | 478 | LIHGIDYESWLYETSPSPKAAEMRMKNVNQLFSWMTEMLEGNELDEPMTLTLVVTRFTLR | 537 |
| A0A0H3H1F3 | A0A0H3H1F3_KLEOK | 478 | LIRGVDYESWLYETSPSPKAAEMRMKNVNTLFTWMTEMLEGSEIDEPMTLTQVVTRFTLR | 537 |
| X7I146 | X7I146_CITFR | 478 | LIHGIDYESWLFETSPSPKAAEMRMKNVNTLFSWMTEMLEQSELEEPMTLTQVVTRFTLR | 537 |
| A0A0H3CTF5 | A0A0H3CTF5_ENTCC | 478 | LIHGIDYESWLYETSASPKAAEMRMKNVNTLFSWMTEMLEGSEIDEPMTLTQVVTRFTLR | 537 |
| D2TH67 | D2TH67_CITRI | 478 | LIHGIDYESWLYETSPSPKAAEMRMKNVNQLFSWMTEMLEGSELDEPMTLTQVVTRFTLR | 537 |
| Q329V6 | Q329V6_SHIDS | 478 | LIHGMDYESWLYETSPSPKAAEMRMKNVNQLFSWMTEMLEGSELDEPMTLTQVVTRFTLR | 537 |
| W6J7C4 | W6J7C4_9ENTR | 478 | LIHGIDYESWLFETSASPKAAEMRMKNVNTLFGWMTEMLEGSELDEPMTLAEVVTRFTLR | 537 |
| I2BE87 | I2BE87_SHIBC | 478 | LIHGIDYESWLFETSPSPKAAEMRMKNVNQLFTWMTEMLEGSDLEEPMTLTQVVTRFTLR | 537 |
| B5EZ38 | B5EZ38_SALA4 | 478 | LIHGIDYESWLYETSPSPKAAEMRMKNVNQLFSWMTEMLEGNELDEPMTLTQVVTRFTLR | 537 |
| A0A0F5SGU2 | A0A0F5SGU2_CITAM | 478 | LIHGIDYESWLYETSPSPKAAEMRMKNVNTLFSWMTEMLEGSELEEPMTLTQVVTRFTLR | 537 |
| G9YY11 | G9YY11_9ENTR | 478 | LIHGIDYESWLFETSPSPKAAEMRMKNVNTLFSWMTEMLEGSELEEPMTLTQVVTRFTLR | 537 |
| A0A090UXU3 | A0A090UXU3_9ENTR | 478 | LIHGIDYESWLFETSPSPKAAEMRMKNVNTLFSWMTEMLEGSELEEPMTLTQVVTRFTLR | 537 |
| A9MJ31 | A9MJ31_SALAR | 478 | LIHGIDYESWLYETSPSPKAAEMRMKNVNQLFSWMTEMLEGNELNEPMTLTQVVTRFTLR | 537 |
| Q3YVI6 | Q3YVI6_SHISS | 478 | LIHGMDYESWLYETSPSPKAAEMRMKNVNQLFSWMTEMLEGSELDEPMTLTQVVTRFTLR | 537 |
| D3RHB6 | D3RHB6_KLEVT | 478 | LIRGIDYESWLYETSPSPKAAEMRMKNVNQLFTWMTEMLEGSEIDEPMTLTQVVTRFTLR | 537 |
| Q57HT8 | Q57HT8_SALCH | 511 | LIHGIDYESWLYETSPSPKAAEMRMKNVNQLFSWMTEMLEGNELDEPMTLTQVVTRFTLR | 570 |
| B5RFS5 | B5RFS5_SALG2 | 478 | LIHGIDYESWLYETSPSPKAAEMRMKNVNQLFSWMTEMLEGNELDEPMTLTQVVTRFTLR | 537 |
| A0A089Q204 | A0A089Q204_9ENTR | 478 | LIHGIDYESWLYETSPSPKAAEMRMKNVNQLFSWMTEMLEGSDLDEPMTLTQVVTRFTLR | 537 |
| A0A0H3BNR1 | A0A0H3BNR1_SALNS | 478 | LIHGIDYESWLYETSPSPKAAEMRMKNVNQLFSWMTEMLEGNELDEPMTLTQVVTRFTLR | 537 |
| C9Y4T0 | C9Y4T0_SICTZ | 478 | LIRGIDYEAWLFETSPSPKAAEMRMKNVNQLFSWMTEMLEGTDLDEPMTLTQVVTRFTLR | 537 |
| B7LU77 | B7LU77_ESCF3 | 478 | LIHGMDYESWLYETSPSPKAAEMRMKNVNQLFSWMTEMLEGSELDEPMTLTQVVTRFTLR | 537 |
| A0A0H3TAW8 | A0A0H3TAW8_SALEN | 478 | LIHGIDYESWLYETSPSPKAAEMRMKNVNQLFSWMTEMLEGNELDEPMTLTQVVTRFTLR | 537 |
| G2S5J6 | G2S5J6_ENTAL | 478 | LIHGIDYESWLYETSASPKAAEMRMKNVNQLFSWMTEMLEGSEIDEPMTLTQVVTRFTLR | 537 |
| A0A0F7JC30 | A0A0F7JC30_SALET | 478 | LIHGIDYESWLYETSPSPKAAEMRMKNVNQLFSWMTEMLEGNELDEPMTLTQVVTRFTLR | 537 |
| A7MQI4 | A7MQI4_CROS8 | 478 | LIRGIDYEAWLFETSPSPKAAEMRMKNVNQLFSWMTEMLEGTDLDEPMTLTQVVTRFTLR | 537 |
| L0M8J0 | L0M8J0_ENTBF | 478 | LIHGIDYESWLFETSASPKAAEMRMKNVNTLFGWMTEMLEGSEIDEPMTLTQVVTRFTLR | 537 |
| A0A0K0HFU2 | A0A0K0HFU2_SALBC | 478 | LIHGIDYESWLYETSPSPKAAEMRMKNVNQLFGWMTEMLEGSDIDEPMTLTQVVTRFTLR | 537 |
| A8ACT1 | A8ACT1_CITK8 | 478 | LIHGIDYESWLYETSPSPKAAEMRMKNVNQLFSWMTEMLEGNELDEPMTLTQVVTRFTLR | 537 |

*Fig. 9F*

Target Residues

| | | | | |
|---|---|---|---|---|
| Q9RTI9 | Q9RTI9_DEIRA | 61  | LAVTFTNKAAAEMRERAGHLVPG--AGDLWMSTFHSAGVRILRTYGEHIGLRRGFVIYDD | 118 |
| P03018 | UVRD_ECOLI   | 58  | MAVTFTNKAAAEMRHRIGQLMGTS-QGGMWVGTFHG LAHRLLRAHIMDANLPQDFQI LDS | 116 |
| P56255 | PCRA_GEOSE   | 60  | LAITFTNKAAREMRERVQSLLGGA-AEDVWISTFH SMCVRILRRDIDRIGINRNFSIL DP | 118 |
| P09980 | REP_ECOLI    | 51  | AAVTFTNKAAREMKERVGQTLGRKEARGLMIST FHTLGLDIIKRRBYAALGMKANFSL PDD | 110 |

Domain 1A

```
       *:******:**:.*    :    : :.***   :::    : *:*
```

| | | | | |
|---|---|---|---|---|
| Q9RTI9 | Q9RTI9_DEIRA | 179 | EAY RRYEVRKKGQNAIDFGDL I TETVRLFKEVPGVLDKVQNKAKFIHVDEYQDTNRAQYE | 238 |
| P03018 | UVRD_ECOLI   | 172 | KVY QAYQEACDRAGLYDFAEL LLRAHELWLNKPHILQHYRERFTNILVDEFQDTNNIQYA | 231 |
| P56255 | PCRA_GEOSE   | 175 | DVYQEY QQRLLRNHSLDFDDLI MTTIQLFDRVPDVLHYYQYKFQYIHIDEYQDTNRAQYT | 234 |
| P09980 | REP_ECOLI    | 166 | HCYGLYDA HLKACNVLDFDDLI LLPTLLLQRNEEVRKRWQNKIRYLLVDEYQDTNTSQYE | 225 |

Domain 1B

```
      . * *:       :** :*:    *    :    .: ::  :**:****  **
```

| | | | | |
|---|---|---|---|---|
| Q9RTI9 | Q9RTI9_DEIRA | 358 | AILYRTNAQSRVIEESLRRVQIPARIVGGVGFYDRREIRDIL AYARLALNPADDVAL RRI | 417 |
| P03018 | UVRD_ECOLI   | 351 | AILYRSNAQSRVLEEALLQASMPYRIYGGMRFFERQEIKDALSY LRLIANRNDD AAFERV | 410 |
| P56255 | PCRA_GEOSE   | 355 | AVLYRTNAQSRVMEEMLLKANIPYQIVGGLKFYDRKEIKDILAY LRVIANPDDD LSLLRI | 414 |
| P09980 | REP_ECOLI    | 346 | AILYRGNHQSRVFEKFLMQNRIPYKISGGTSFFSRPEIKDLL AYLRVLTNPDDDSAF LRI | 405 |

```
      *:***  * *****:*:  *  :  :*  :* **  *:.* **:* *:* *  *  **  :: *:
```

| | | | | |
|---|---|---|---|---|
| Q9RTI9 | Q9RTI9_DEIRA | 418 | IGRPRRGIGDTALQKI MEWARTHHTSVLTA CANAAE-QNILDRGAHKATEFAGLMEAMSE | 476 |
| P03018 | UVRD_ECOLI   | 411 | VNTPTRGIGDRTLDVVRQTS RDRQLTLWQ ACRELLQEKALAGRAASALQRFMELIDALAQ | 470 |
| P56255 | PCRA_GEOSE   | 415 | INVPKRGIGASTIDKLVRY AADHELSLFEA LGELEM-IGLGAKAAGALAAFRSQLEQWTQ | 473 |
| P09980 | REP_ECOLI    | 406 | VNTPKREIGPATLKKL GEWAMTRNKSMFTA SFDMGLSQTLSGRGYEALTRFTHWLAEIQR | 465 |

Domain 2B

```
       :  *   *   **   :: .      . ::    ..*   :   .         *      :   .
```

| | | | | |
|---|---|---|---|---|
| Q9RTI9 | Q9RTI9_DEIRA | 477 | AADNYEPAAFLRFVMETSGYLDLLR-----QEGQEGQVRLENLEELVSAAEEWSQD EANV-G | 532 |
| P03018 | UVRD_ECOLI   | 471 | ETADMPLHVQTDRVIKDSGLRTM-YEQE-KGEKGQTRIENLEELVTATRQFSYNEED EDL | 528 |
| P56255 | PCRA_GEOSE   | 474 | LQEYVSVTELVEEVLDKSGYREM-LKAE-RTIEAQSRLENLDEFLSVTKHFENV SDDKSL | 531 |
| P09980 | REP_ECOLI    | 466 | LAEREPIAAVRDL-IHGMDYESWLYETSPSPKAAEMRMKNVNQLFSWMTEMLEGSELDEP | 524 |

```
          :.         .:  *::*:::.:  .
```

| | | | | |
|---|---|---|---|---|
| Q9RTI9 | Q9RTI9_DEIRA | 533 | GSIADFLDDAAI LSSVDDMRTKAENKGAPEDAVTLMTLHNAKGLEFPVVFIVGVEQGLLP | 592 |
| P03018 | UVRD_ECOLI   | 529 | MPLQAPLSHAAL EA------GEG--QADTWQDAVQLMTLHSAKGLEFPVVFIVGMEEGMFP | 581 |
| P56255 | PCRA_GEOSE   | 532 | IAF----LTDLAL ISDLDELDGT---EQAAEGDAVMLMTLHAAKGLEFPVVFLIGMEEGIFP | 586 |
| P09980 | REP_ECOLI    | 525 | MTLTQVVTRFT L----RDMMERG--ESEEELDQVQLMTLHASKGLEFPVVYMVGMEEGFLP | 579 |

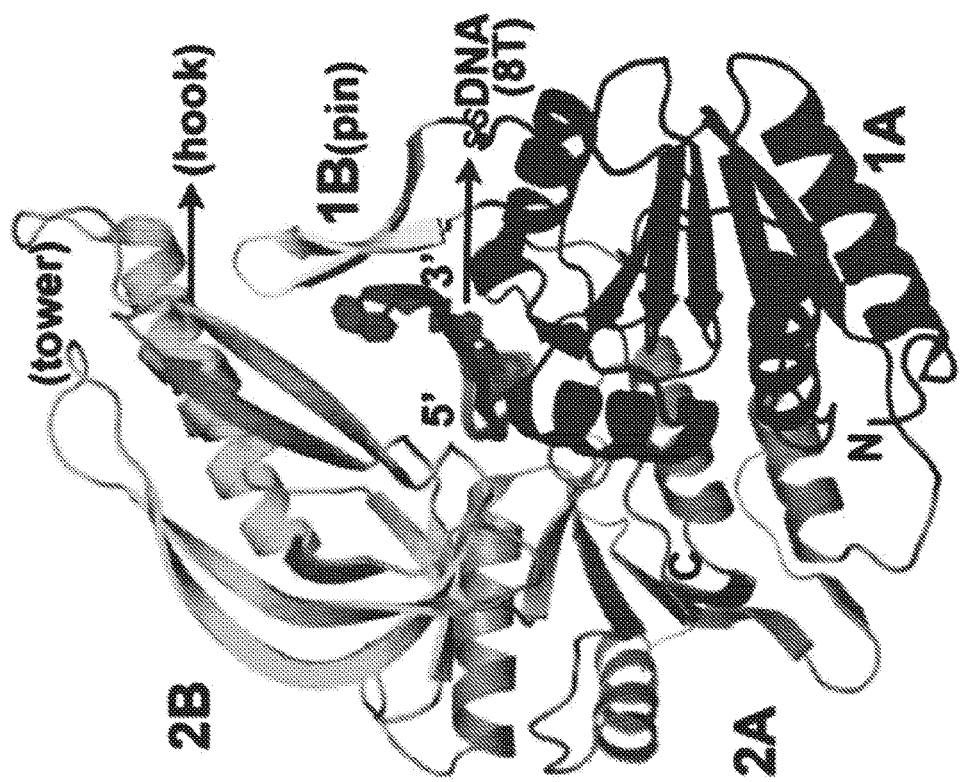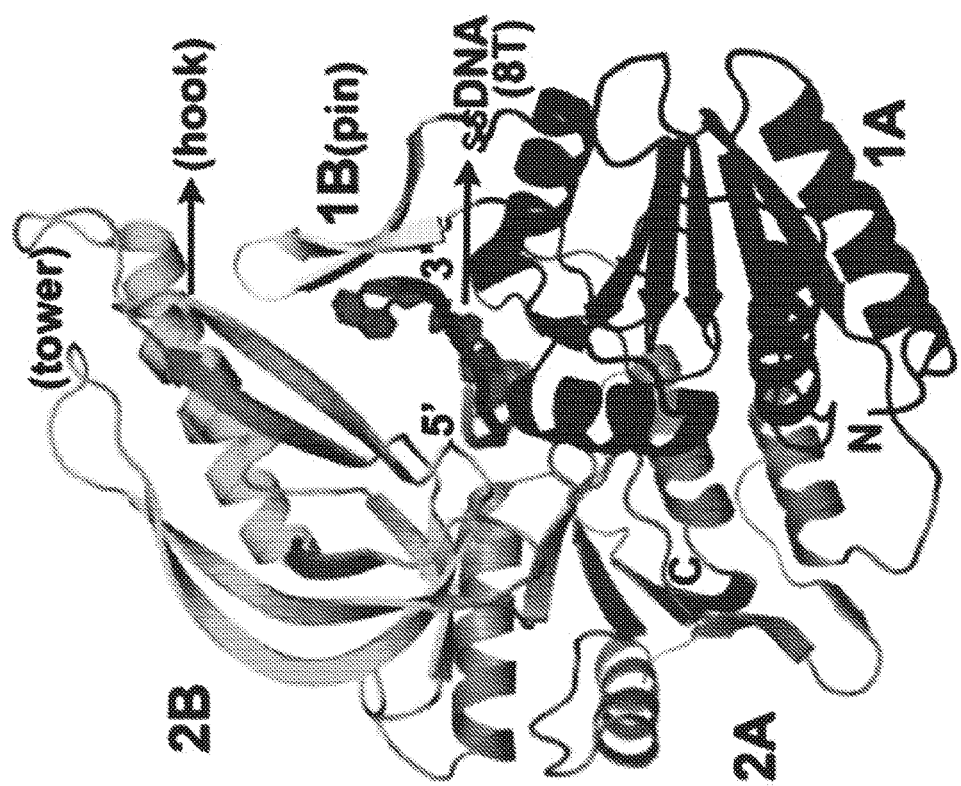
Fig. 16

BIO-ENGINEERED HYPER-FUNCTIONAL "SUPER" HELICASES

RELATED APPLICATIONS

This application is a 35 U.S.C. § 371 filing of International Patent Application No. PCT/US2015/060693, filed Nov. 13, 2015, which claims the benefit of U.S. Provisional Patent Application Ser. No. 62/079,183, filed Nov. 13, 2014, the disclosures of which are incorporated herein by reference in their entirety.

STATEMENT REGARDING FEDERALLY SPONSORED RESEARCH OR DEVELOPMENT

This invention was made with government support under GM065367 awarded by the National institutes of Health. The United States Government has certain rights in the invention.

SEQUENCE LISTING

The instant application contains a Sequence Listing which has been submitted electronically in ASCII format and is hereby incorporated by reference in its entirety.

FIELD OF THE INVENTION

The present disclosure relates to compositions and methods fix helicase-mediated DNA unwinding activity.

BACKGROUND

A traditional definition of a helicase is an enzyme that catalyzes the reaction of separating/unzipping/unwinding the helical structure of nucleic acid duplexes (DNA, RNA or hybrids) into single-stranded components, using nucleoside triphosphate (NTP) hydrolysis as the energy source (such as ATP). However, it should be noted that not all helicases fit this definition anymore. A more general definition is that they are motor proteins that move along the single-stranded or double stranded nucleic acids (usually in a certain direction, 3' to 5' or 5 to 3, or both), i.e. translocases, that can or cannot unwind the duplexed nucleic acid encountered. In addition, some helicases simply bind and "melt" the duplexed nucleic acid structure without an apparent translocase activity.

Helicases exist in all living organisms and function in all aspects of nucleic acid metabolism. Helicases are classified based on the amino acid sequences, directionality, oligomerization state and nucleic-acid type and structure preferences. The most common classification method was developed based on the presence of certain amino acid sequences, called motifs. According to this classification helicases are divided into 6 super families: SF1, SF2, SF3, SF4, SF5 and SF6. SF1 and SF2 helicases do not form a ring structure around the nucleic acid, whereas SF3 to SF6 do. Superfamily classification is not dependent on the classical taxonomy.

DNA helicases are responsible for catalyzing the unwinding of double-stranded DNA (dsDNA) molecules to their respective single-stranded nucleic acid (ssDNA) forms. Although structural and biochemical studies have shown how various helicases can translocate on ssDNA directionally, consuming one ATP per nucleotide, the mechanism of nucleic acid unwinding and how the unwinding activity is regulated remains unclear and controversial (T. M. Lohman, E. J. Tomko, C. G. Wu, "Non-hexameric DNA helicases and translocases: mechanisms and regulation," *Nat Rev Mol Cell Biol* 9:391-401 (2008)). Since helicases can potentially unwind all nucleic acids encountered, understanding how their unwinding activities are regulated can lead to harnessing helicase functions for biotechnology applications.

BRIEF SUMMARY OF THE INVENTION

The present invention is based on the discovery of novel modified helicases that show dramatically enhanced helicase activity and increased strength as compared to unmodified helicases. As described further herein, it has been surprisingly discovered that, by controlling the conformation of certain subdomains such that the helicase remains in a closed form (e.g., by covalently crosslinking the 2B domain to the 1A domain or the 1B domain in a Rep helicase), a highly active and strong form of the helicase is achieved.

In one aspect, a composition for catalyzing an unwinding reaction on double-stranded DNA is provided that includes a conformationally-constrained helicase.

In another aspect, a method of catalyzing an unwinding reaction of a double-stranded DNA is provided. The method includes the step of contacting the double-stranded DNA with a conformationally-constrained helicase in the presence of ATP.

In another aspect, an isolated nucleic acid that encodes a helicase polypeptide having the capability to be constrained in a conformation by an intramolecular crosslinking agent is provided.

In another aspect, a modified helicase comprising a first subdomain having a first amino acid and a second subdomain having a second amino acid is provided. Said first amino acid is at least about 30 Å from said second amino acid when the helicase is in an inactive conformation, and said first amino acid is less than about 20 Å from said second amino acid when the helicase is in an active conformation. A side chain of the first amino acid is covalently crosslinked to a side chain of the second amino acid with a linker to form an active, conformationally-constrained helicase.

In certain exemplary embodiments, the modified helicase is a Super Family 1 (SF1) helicase (e.g., an SF1A or an SF1B helicase) or a Super Family 2 (SF2) helicase.

In certain exemplary embodiments, the first amino acid is less than about 20 Å, about 19 Å, about 18 Å, about 17 Å, about 16 Å, about 15 Å, about 10 Å, about 9 Å, about 8 Å, about 7 Å, about 5 Å, or about 4 Å from the second amino acid when the helicase is in an active conformation.

In certain exemplary embodiments, the first amino acid is at least about 30 Å, about 40 Å, about 50 Å, about 55 Å, about 60 Å, about 65 Å, about 70 Å, about 75 Å, about 80 Å or about 85 Å from the second amino acid when the helicase is in an inactive conformation.

In certain exemplary embodiments, the helicase is selected from the group consisting of a Rep helicase (e.g., from *E. coli*), a UvrD helicase (e.g., from *E. coli*) and a PcrA helicase (e.g., from *B. stearothermophilus*).

In certain exemplary embodiments, the first amino acid is at any one of positions 84-116 or 178-196 of the modified helicase amino acid sequence, and the helicase is a Rep, PcrA or UvrD helicase, or homolog thereof.

In certain exemplary embodiments, the first amino acid is at any one of positions 92-116 or 178-196 of the modified helicase amino acid sequence, and the helicase is a PcrA helicase, or homolog thereof.

In certain exemplary embodiments, the first amino acid is at any one of positions 84-108 or 169-187 of the modified helicase amino acid sequence, and the helicase is a Rep helicase, or homolog thereof.

In certain exemplary embodiments, the first amino acid is at any one of positions 90-114 or 175-193 of the modified helicase amino acid sequence, and the helicase is a UvrD helicase, or homolog thereof.

In certain exemplary embodiments, the first amino acid at position 178 of the modified helicase amino acid sequence, and the helicase is a Rep helicase, or homolog thereof.

In certain exemplary embodiments, the first amino acid is at position 187 of the modified helicase amino acid sequence, and the helicase is a PcrA helicase, or homolog thereof.

In certain exemplary embodiments, the first amino acid is present in an amino acid sequence having at least 20% amino acid sequence identity to SEQ ID NO:13 or SEQ ID NO:14, and the helicase is a Rep helicase, or homolog thereof.

In certain exemplary embodiments, the second amino acid is present in an amino acid sequence having at least 20% amino acid sequence identity to SEQ ID NO:15 or SEQ ID NO:16, and the helicase is a Rep helicase, or homolog thereof.

In certain exemplary embodiments, the second amino acid residue is at any one of positions 388-411, 422-444 and 518-540 of the modified helicase amino acid sequence, and the helicase is a Rep, PcrA or UvrD helicase, or homolog thereof.

In certain exemplary embodiments, the second amino acid is at any one of positions 397-411, 431-444 or 526-540 of the modified helicase amino acid sequence, and the helicase is a PcrA helicase, or homolog thereof.

In certain exemplary embodiments, the second amino acid is at any one of positions 388-402, 422-435 or 519-531 of the modified helicase amino acid sequence, and the helicase is a Rep helicase, or homolog thereof.

In certain exemplary embodiments, the second amino acid is at any one of positions 393-407, 427-440 or 523-540 of the modified helicase amino acid sequence, and the helicase is a UvrD helicase, or homolog thereof.

In certain exemplary embodiments, the second amino acid is at position 400 of the modified helicase amino acid sequence, and the helicase is a Rep helicase, or homolog thereof.

In certain exemplary embodiments, the second amino acid is at position 409 of the modified helicase amino acid sequence, and the helicase is a PcrA helicase, or homolog thereof.

In certain exemplary embodiments, the first amino acid is at any one of positions 60-82 of the modified helicase amino acid sequence, and the helicase is a Rep helicase, or homolog thereof. In certain exemplary embodiments, the first amino acid is at any one of positions 68-79 of the modified helicase amino acid sequence, and the helicase is a Rep helicase, or homolog thereof.

In certain exemplary embodiments, the first amino acid is at any one of positions 69-89 of the modified helicase amino acid sequence, and the helicase is a PcrA helicase, or homolog thereof. In certain exemplary embodiments, the first amino acid is at any one of positions 77-87 of the modified helicase amino acid sequence, and the helicase is a PcrA helicase, or homolog thereof.

In certain exemplary embodiments, the first amino acid is at any one of positions 67-87 of the modified helicase amino acid sequence, and the helicase is a UvrD helicase, or homolog thereof. In certain exemplary embodiments, the first amino acid is at any one of positions 75-85 of the modified helicase amino acid sequence, and the helicase is a UvrD helicase, or homolog thereof.

In certain exemplary embodiments, the second amino acid is at any one of positions 509-536 of the modified helicase amino acid sequence, and the helicase is a Rep helicase, or homolog thereof. In certain exemplary embodiments, the second amino acid is at any one of positions 519-525 of the modified helicase amino acid sequence, and the helicase is a Rep helicase, or homolog thereof.

In certain exemplary embodiments, the second amino acid is at any one of positions 516-534 of the modified helicase amino acid sequence, and the helicase is a PcrA helicase, or homolog thereof. In certain exemplary embodiments, the second amino acid is at any one of positions 526-532 of the modified helicase amino acid sequence, and the helicase is a PcrA helicase, or homolog thereof.

In certain exemplary embodiments, the second amino acid is at any one of positions 513-531 of the modified helicase amino acid sequence, and the helicase is a UvrD helicase, or homolog thereof. In certain exemplary embodiments, the second amino acid is at any one of positions 523-529 of the modified helicase amino acid sequence, and the helicase is a UvrD helicase, or homolog thereof.

In certain exemplary embodiments, said first subdomain and said second subdomain comprise no more than a total of two cysteine residues.

In certain exemplary embodiments, the helicase comprises one cysteine residue and/or is from a bacterium selected from the group consisting of *Deinococcus geothermalis, Meiothermus* sp., *Marinithermus hydrothermalis, Marinithermus hydrothermalis* and *Oceanithermus profundus*.

In certain exemplary embodiments, the helicase comprises one cysteine residue or no cysteine residues and/or is from a bacterium selected from the group consisting of *Thermococcus* sp. EXT9, *Thermococcus* sp. IRI48 *Thermococcus* sp. IRI33, *Thermococcus* sp. AMT7, *Thermococcus nautili, Thermococcus onnurineus* (strain NA1), *Thermococcus kodakarensis* (strain ATCC BAA-918/JCM 12380/KOD1) (*Pyrococcus kodakaraensis* (strain KOD1)), *Thermococcus sibiricus* (strain MM 739/DSM 12597), *Thermococcus paralvinellae, Thermus aquaticus* Y51MC23, *Thermus aquaticus* Y51MC23, *Thermus aquaticus* Y51MC23, *Thermus* sp. RL, *Thermus* sp. RL, *Thermus* sp. 2.9, *Salinisphaera hydrothermalis* C41B8, *Thermus filiformis, Meiothermus ruber, Thermus* sp. NMX2.A1, *Thermus thermophilus* JL-18, *Thermus scotoductus* (strain ATCC 700910/SA-01), *Thermus scotoductus* (strain ATCC 700910/SA-01), *Oceanithermus profundus* (strain DSM 14977/NBRC 100410/VKM B-2274/506), *Oceanithermus profundus* (strain DSM 14977/NBRC 100410/VKM B-2274/506), *Oceanithermus profundus* (strain DSM 14977/NBRC 100410/VKM B-2274/506), *Oceanithermus profundus* (strain DSM 14977/NBRC 100410/VKM B-2274/506), *Oceanithermus profundus* (strain DSM 14977/NBRC 100410/VKM B-2274506), *Thermus oshimai* JL-2, *Thermus oshimai* JL-2, *Thermus oshimai* JL-2, *Thermomonospora curvata* (strain ATCC 19995/DSM 43183/JCM 3096/NCIMB 10081), *Thermodesulfatator indicus* (strain DSM 15286/JCM 11887/CIR29812), *Geobacillus stearothermophilus* (*Bacillus stearothermophilus*), *Coprothermobacter proteolyticus* (strain ATCC 35245/DSM 5265/BT), *Meiothermus silvanus* (strain ATCC 700542/DSM 9946/VI-R2) (*Thermus silvanus*), *Anaerolinea thermophila* (strain DSM 14523/JCM 11388/NBRC 100420/UNI-1), *Thermoanaerobacterium thermosaccharolyticum* M0795, *Meiothermus ruber* (strain ATCC 35948/DSM 1279/VKM B-1258/21) (*Thermus ruber*), *Meiothermus ruber* (strain ATCC 35948/DSM 1279/VKM B-1258/21) (*Thermus ruber*), *Deinococcus radiodurans* (strain ATCC 13939/DSM 20539/JCM 16871/LMG 4051/NBRC 15346/NCIMB 9279/R1/VKM B-1422), *Thermodesulfobium narugense* DSM 14796, *Thermus thermophilus* (strain HB8/ATCC 27634/DSM 579), *Dictyoglomus thermophilum* (strain ATCC 35947/DSM 3960/H-6-12), *Thermus thermophilus* (strain SG0.5JP17-16), *Thermus thermophilus* (strain SG0.5JP17-16), *Thermus thermophilus* (strain SG0.5JP17-16), *Thermus* sp. CCB_US3_UF1, *Deinococcus geothermalis* (strain DSM 11300), *Thermus thermophilus* (strain HB27/ATCC BAA-163/DSM 7039), *Thermus thermophilus* (strain HB27/ATCC BAA-163/DSM 7039), *Marinithermus hydrothermalis* (strain DSM 14884/JCM 11576/T1).

In certain exemplary embodiments, the first amino acid and the second amino acid are each independently an unnatural amino acid or a natural amino acid.

In certain exemplary embodiments, one or more of an amino acid of the helicase is substituted with an unnatural amino acid or a natural amino acid (e.g., a cysteine or a homocysteine).

In certain exemplary embodiments, said helicase comprises a sequence selected from SEQ ID NOs:4 and 12.

In certain exemplary embodiments, the first amino acid is covalently crosslinked to the second amino acid by a disulfide bond or by a chemical crosslinker (e.g., a chemical crosslinker having a length of from about 6 Å to about 25 Å).

In certain exemplary embodiments, the chemical crosslinker is a his-maleimide crosslinker.

In certain exemplary embodiments, the chemical crosslinker is selected from the group consisting of

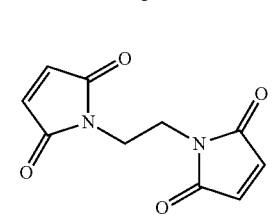

1-[2-(2,5-dioxopyrrol-1-yl)ethyl]pyrrole-2,5-dione,

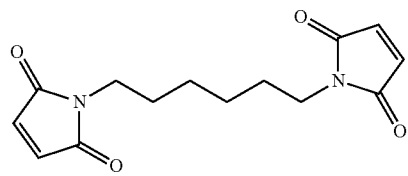 [SMILES: O=C1C=CC(=O)N1CCCCCCN1C(=O)C=CC1=O]

1-[6-(2,5-dioxopyrrol-1-yl)hexyl]pyrrole-2,5-dione,

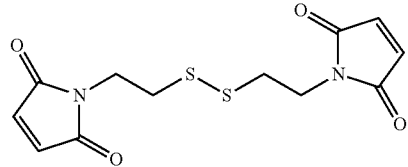 [SMILES: O=C1C=CC(=O)N1CCSSCCN1C(=O)C=CC1=O]

1-[2-[2-(2,5-dioxopyrrol-1-yl)ethyldisulfanyl]ethyl]pyrrole-2,5-dione,

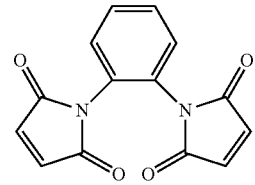 [SMILES: O=C1C=CC(=O)N1c1ccccc1N1C(=O)C=CC1=O]

1-[2-(2,5-dioxopyrrol-1-yl)phenyl]pyrrole-2,5-dione, and

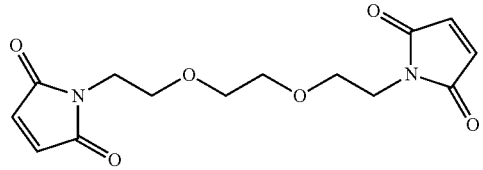

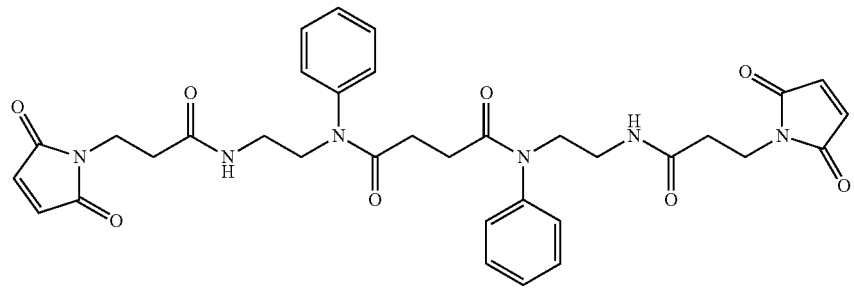 [SMILES: O=C(CCN1C(=O)C=CC1=O)NCCN(C(=O)CCC(=O)N(CCNC(=O)CCN1C(=O)C=CC1=O)c1ccccc1)c1ccccc1]

1-[2-[2-[2-(2,5-dioxopyrrol-1-yl)ethoxy]ethoxy]ethyl]pyrrole-2,5-dione,

N,N'-bis[2-[3-(2,5-dioxopyrrol-1-yl)propanoylamino]ethyl]-N,N'-diphenylbutanediamide.

In certain exemplary embodiments, the chemical crosslinker is

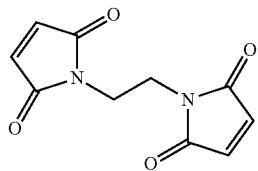

1-[2-(2,5-dioxopyrrol-1-yl)ethyl]pyrrole-2,5-dione.

In one aspect, a modified helicase comprising a first subdomain having a first amino acid and a second subdomain having a second amino acid, wherein said first amino acid is at least about 30 Å from said second amino acid when the helicase is in an inactive conformation, and said first amino acid is less than about 20 Å from said second amino acid when the helicase is in an active conformation, and wherein a side chain of the first amino acid is chemically crosslinked to a side chain of the second amino acid using

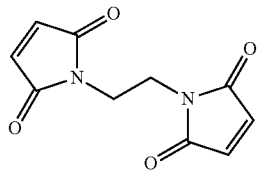 [SMILES: O=C1C=CC(=O)N1CCN1C(=O)C=CC1=O]

1-[2-(2,5-dioxopyrrol-1-yl)ethyl]pyrrole-2,5-dione to form an active, conformationally-constrained helicase is provided.

In another aspect, a modified Rep, PcrA or UvrD helicase or homolog thereof, comprising a first subdomain having a first amino acid at any one of positions 84-116 and a second subdomain having a second amino acid at any one of positions 388-411, 422-444 and 518-540, wherein a side chain of the first amino acid is covalently crosslinked to a side chain of the second amino acid with a linker to form an active, conformationally-constrained Rep, PcrA or UvrD helicase, or homolog thereof is provided.

In another aspect, a modified Rep helicase or homolog thereof comprising an amino acid at position 178 covalently crosslinked to an amino acid at position 400 to form an active, conformationally-constrained Rep helicase or homolog thereof is provided.

In another aspect, a modified Rep helicase or homolog thereof comprising an amino acid at position 187 covalently crosslinked to an amino acid at position 409, to form an active, conformationally-constrained helicase is provided.

In another aspect, a modified helicase comprising a first subdomain having a first amino acid and a second subdomain having a second amino acid, wherein said first amino acid is at least about 30 Å from said second amino acid when the helicase is in an inactive conformation, and said first amino acid is less than about 20 Å from said second amino acid when the helicase is in an active conformation, and wherein a side chain of the first amino acid is covalently crosslinked to a side chain of the second amino acid with a chemical crosslinker to form an active, conformationally-constrained helicase, and wherein one or more of an amino acid of the helicase is substituted with an unnatural amino acid or a natural amino acid is provided.

In one aspect, a method of making an active, conformationally-constrained helicase is provided. The method includes the steps of selecting in a helicase a first amino acid in a first subdomain that is at least about 30 Å from a second amino acid in a second subdomain when the helicase is in an inactive conformation, and the first amino acid is less than about 20 Å from the second amino acid when the helicase is in an active conformation, and covalently crosslinking the first amino acid to the second amino acid when the helicase is in an active conformation to form an active, conformationally-constrained helicase.

In a certain exemplary embodiment, the method includes two steps. The first step includes expressing a helicase polypeptide having the capability to be constrained in a conformation by an intramolecular crosslinking agent from an isolated nucleic acid selected from a group consisting of SEQ ID NOs: 2, 3, 5 and 6. The second step includes reacting the helicase polypeptide with an intramolecular crosslinking agent to form the conformationally-constrained helicase.

In certain exemplary embodiments, the modified helicase is a Super Family 1 (SF1) helicase (e.g., SF1A or SF1B) or a Super Family 2 (SF2) helicase.

In certain exemplary embodiments, the first subdomain comprises a 1A subdomain or a 1B subdomain and the second subdomain comprises a 2B subdomain.

In certain exemplary embodiments, the first amino acid is less than about 20 Å, about 19 Å, about 18 Å, about 17 Å, about 16 Å, about 15 Å, about 10 Å, about 9 Å, about 8 Å, about 7 Å, about 5 Å, or about 4 Å from the second amino acid when the helicase is in an active conformation.

In certain exemplary embodiments, the first amino acid is at least about 30 Å, about 35 Å, about 40 Å, about 45 Å, about 50 Å, about 55 Å, about 60 Å, about 65 Å, about 70 Å, about 75 Å, about 80 Å or about 85 Å from the second amino acid when the helicase is in an inactive conformation.

In certain exemplary embodiments, the helicase is selected from the group consisting of a Rep helicase, a UvrD helicase and a PcrA helicase.

In certain exemplary embodiments, the helicase comprises a sequence selected from SEQ ID NOs:4 and 12.

In certain exemplary embodiments, the first amino acid is covalently linked to the second amino acid by a disulfide bond or a chemical crosslinker.

In another aspect, a method of catalyzing an unwinding reaction of a double-stranded DNA, comprising contacting the double-stranded DNA with a modified helicase comprising a first subdomain having a first amino acid and a second subdomain having a second amino acid is provided. Said first amino acid is at least about 30 Å from said second amino acid when the helicase is in an inactive conformation, and said first amino acid is less than about 20 Å from said second amino acid when the helicase is in an active conformation. A side chain of the first amino acid is covalently crosslinked to a side chain of the second amino acid with a linker to form an active, conformationally-constrained helicase.

In certain exemplary embodiments, the conformationally-constrained helicase comprises SEQ ID NO: 4 or SEQ ID NO:12.

In certain exemplary embodiments, the conformationally-constrained helicase is chemically crosslinked.

In certain exemplary embodiments, the linker comprises an alkyl having a length in the range from C7 to C23 or from C8 to C13.

In another aspect, a method of performing isothermal DNA amplification, comprising combining a DNA template, the conformationally-constrained helicase described above and amplification reagents. under conditions compatible for performing isothermal DNA amplification.

In certain exemplary embodiments, the method includes two steps. The first step includes forming a mixture. The mixture includes a double-stranded DNA template having a first strand and a second strand; a conformationally-constrained helicase; a DNA-dependent DNA polymerase; a first oligonucleotide primer complementary to a portion of the first strand; a second oligonucleotide primer complementary to a portion of the second strand; and an amplification buffer cocktail. The second step includes incubating the mixture at a temperature compatible for activating the conformationally-constrained helicase and DNA-dependent DNA polymerase.

In certain exemplary embodiments, the conformationally-constrained helicase comprises SEQ ID NO:4 or 12. In certain exemplary embodiments, the DNA-dependent DNA polymerase is selected from a group consisting of E. coli DNA Pol I, E. coli DNA Pol Large Fragment, Bst 2.0 DNA Polymerase, Bst DNA Polymerase, Bst DNA Polymerase Large Fragment, Bsu DNA Polymerase I Large Fragment, T4 DNA Polymerase, T7 DNA polymerase, PyroPhage® 3173 DNA Polymerase and phi29 DNA Polymerase.

In certain exemplary embodiments, the conformationally-constrained helicase is chemically crosslinked.

In certain exemplary embodiments, the chemical crosslinker comprises a length in the range from about 6 Å to about 25 Å.

In certain exemplary embodiments, the chemical crosslinker comprises an alkyl having a length in the range from C7 to C23 or from C8 to C13.

In another aspect, a kit for performing helicase dependent amplification is provided. The kit includes a conformationally-constrained helicase and amplification reagents (e.g., an amplification buffer cocktail).

In certain exemplary embodiments, the conformationally-constrained helicase is selected from SEQ ID NOs: 4 and 12.

In certain exemplary embodiments, the kit further comprising a DNA-dependent DNA polymerase, e.g., selected from a group consisting of E. coli DNA Pol I, E. coli DNA Pol I Large Fragment, Bst 2.0 DNA Polymerase, Bst DNA Polymerase, Bst DNA Polymerase Large Fragment, Bsu DNA Polymerase I Large Fragment, T4 DNA Polymerase, T7 DNA polymerase, PyroPhage® 3173 DNA Polymerase and phi29 DNA Polymerase.

In one aspect, an isolated nucleic acid encoding a modified helicase described herein is provided.

In certain exemplary embodiments, the isolated nucleic acid is selected from the group consisting of SEQ ID NOs: 2, 3, 10 and 11.

In one aspect, a modified E. coli. Rep helicase comprising a first subdomain having a first amino acid, a second subdomain having a second amino acid, and an axis vector defined by the alpha carbon of ILE371 from which the vector originates and the alpha carbon of SER280 or the alpha carbon of ALA603, wherein theta is an angle of rotation of said first amino acid and said second amino acid around the axis vector is provided. A first theta between said first amino acid and said second amino acid is between about 60 degrees and about 155 degrees when the helicase is in an inactive conformation, and a second theta between said first amino acid and said second amino acid is between about 355 degrees and about 25 degrees when the helicase is in an active conformation. A side chain of the first amino acid is covalently crosslinked to a side chain of the second amino acid with a linker to form an active, conformationally-constrained helicase.

In certain exemplary embodiments, the first theta is about 133 degrees and/or the second theta is about 0 degrees.

In certain exemplary embodiments, the axis vector is defined by the alpha carbon of ILE371 and the alpha carbon of SER280.

In certain exemplary embodiments, the first amino acid is at any one of positions 84-108 or 169-187 or at position 178 of the modified helicase amino acid sequence. In certain exemplary embodiments, the first amino acid is present in an amino acid sequence having at least 20% amino acid sequence identity to SEQ ID NO:13 or SEQ ID NO:14. In certain exemplary embodiments, the first amino acid is at any one of positions 60-82 of the modified helicase amino acid sequence. In certain exemplary embodiments, the first amino acid is at any one of positions 68-79 of the modified helicase amino acid sequence.

In certain exemplary embodiments, the second amino acid is at any one of positions 388-402, 422-435 or 519-531 or at position 400 of the modified helicase amino acid sequence. In certain exemplary embodiments, the first amino acid is present in an amino acid sequence having at least 20% amino acid sequence identity to SEQ ID NO:15 or SEQ ID NO:16. In certain exemplary embodiments, the second amino acid is at any one of positions 509-536 of the modified helicase amino acid sequence. In certain exemplary embodiments, the second amino acid is at any one of positions 519-525 of the modified helicase amino acid sequence.

These and other features, objects and advantages of the present invention will become better understood from the description that follows. In the description, reference is made to the accompanying drawings, which form a part hereof and in which there is shown by way of illustration, not limitation, embodiments of the invention.

BRIEF DESCRIPTION OF TILE DRAWINGS

FIG. 1A depicts the closed form Rep crystal structure (PDB entry 1UAA), wherein subdomains are colored and named accordingly and 3' end of the ssDNA (gray) is visible. Residues that were mutated to cysteine and crosslinked to lock the conformation are shown as pink, blue and red van der Waals spheres in both conformations as reference. Boxed area is magnified view showing the two residues that were crosslinked for engineering Rep-X.

FIG. 1B depicts the open form Rep crystal structure (PDB entry 1UAA), wherein subdomains are colored and named accordingly and 3' end of the ssDNA (gray) is visible. Residues that were mutated to cysteine and crosslinked to lock the conformation are shown as pink, blue and red van der Waals spheres in both conformations as reference. Boxed area is magnified view showing the two residues that were crosslinked for engineering Rep-Y.

FIG. 1C depicts a schematic showing that helicase-catalyzed unwinding of a DNA labeled with a donor and an acceptor would convert high FRET efficiency ($E_{FRET}$) to low $E_{FRET}$. Shading level of the donor and acceptor color represents the relative intensity changes. Figure discloses "$(dT)_{10}$" as SEQ ID NO: 33.

FIG. 10 depicts an ensemble unwinding kinetics of DNA from FIG. 1C by Rep and Rep-X shows the enhanced helicase activity of Rep-X over Rep as measured via ensemble $E_{FRET}$. Solid lines are fitted exponential decay curves as guides to the eye.

FIG. 1E depicts exemplary data of ensemble unwinding kinetics of the Rep-Y, Rep-X and non-crosslinked Rep using an assay containing 10 nM helicase, 5 nM 50-bp ensemble unwinding DNA with 3'-(dT)$_{30}$ (SEQ ID NO: 17) overhang in buffer D and 1 mM ATP).

Figure 3A:
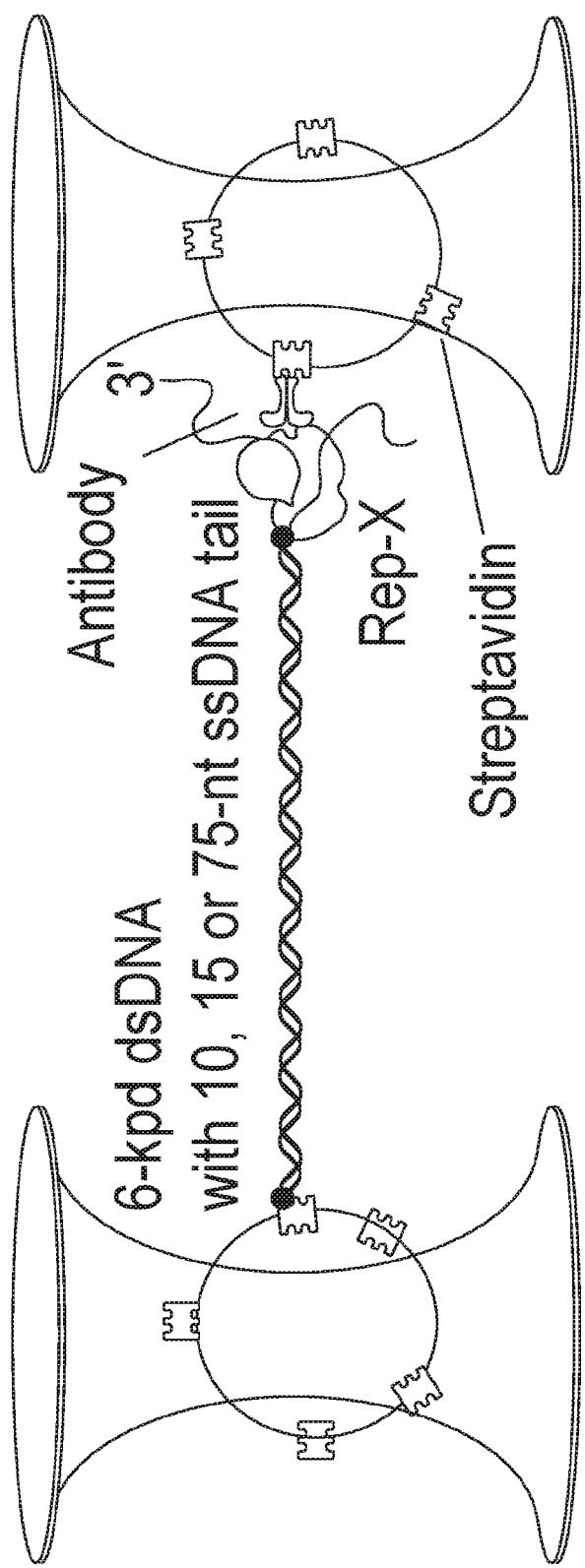
FIG. 3A depicts a schematic of the optical tweezers assay depicts a Rep-X molecule tethered to the bead surface that just loaded on the free ssDNA overhang and started to unwind the 6-kbp DNA=.
Figure 3B:
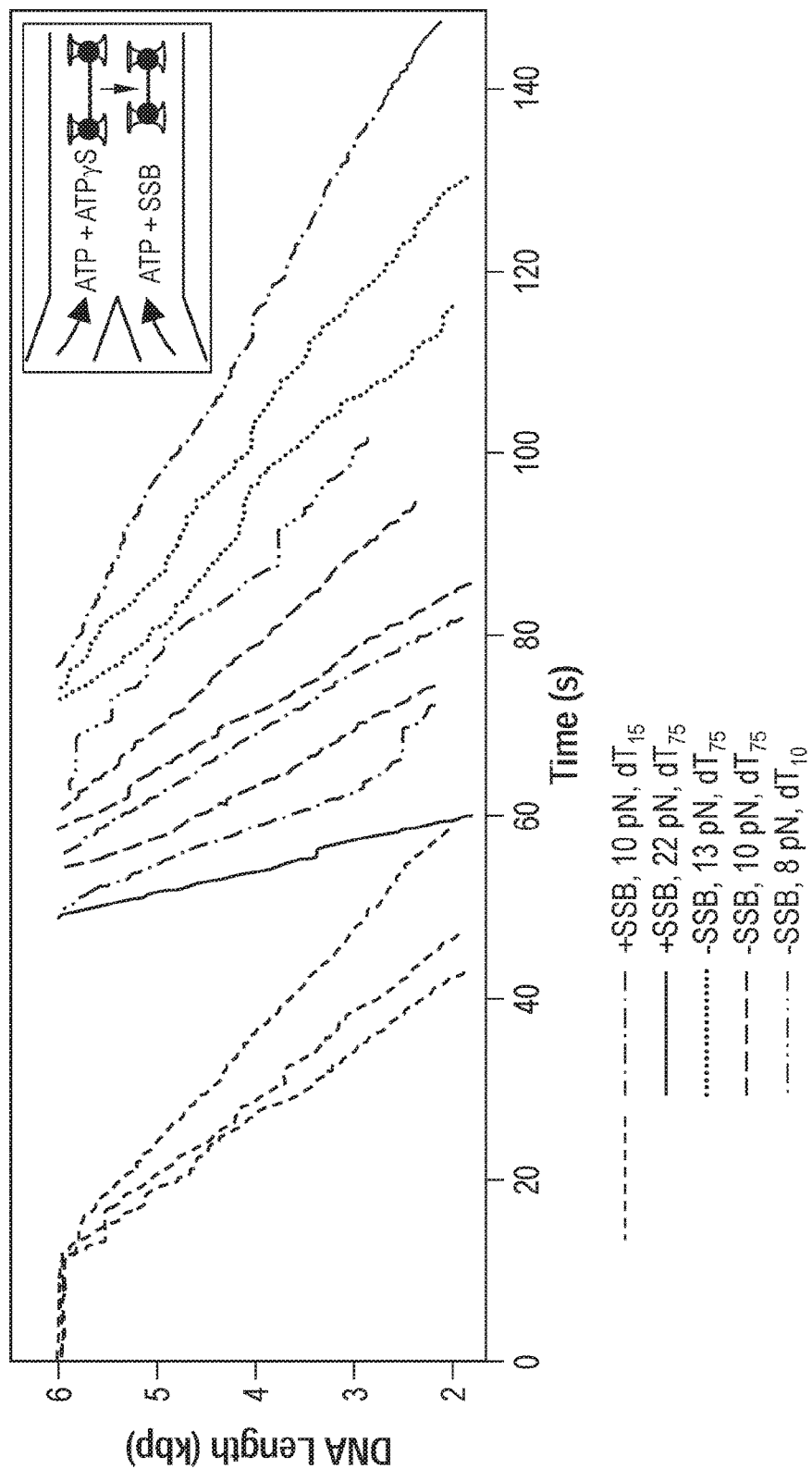
FIG. 3B depicts unwinding traces showing the extent of processive unwinding by Rep-X on the 6-kbp DNA (colored according to conditions of overhang length, SSB and force, and offset for clarity). Background is color coordinated with the inset to show the two laminar flows.
Figure 3C:
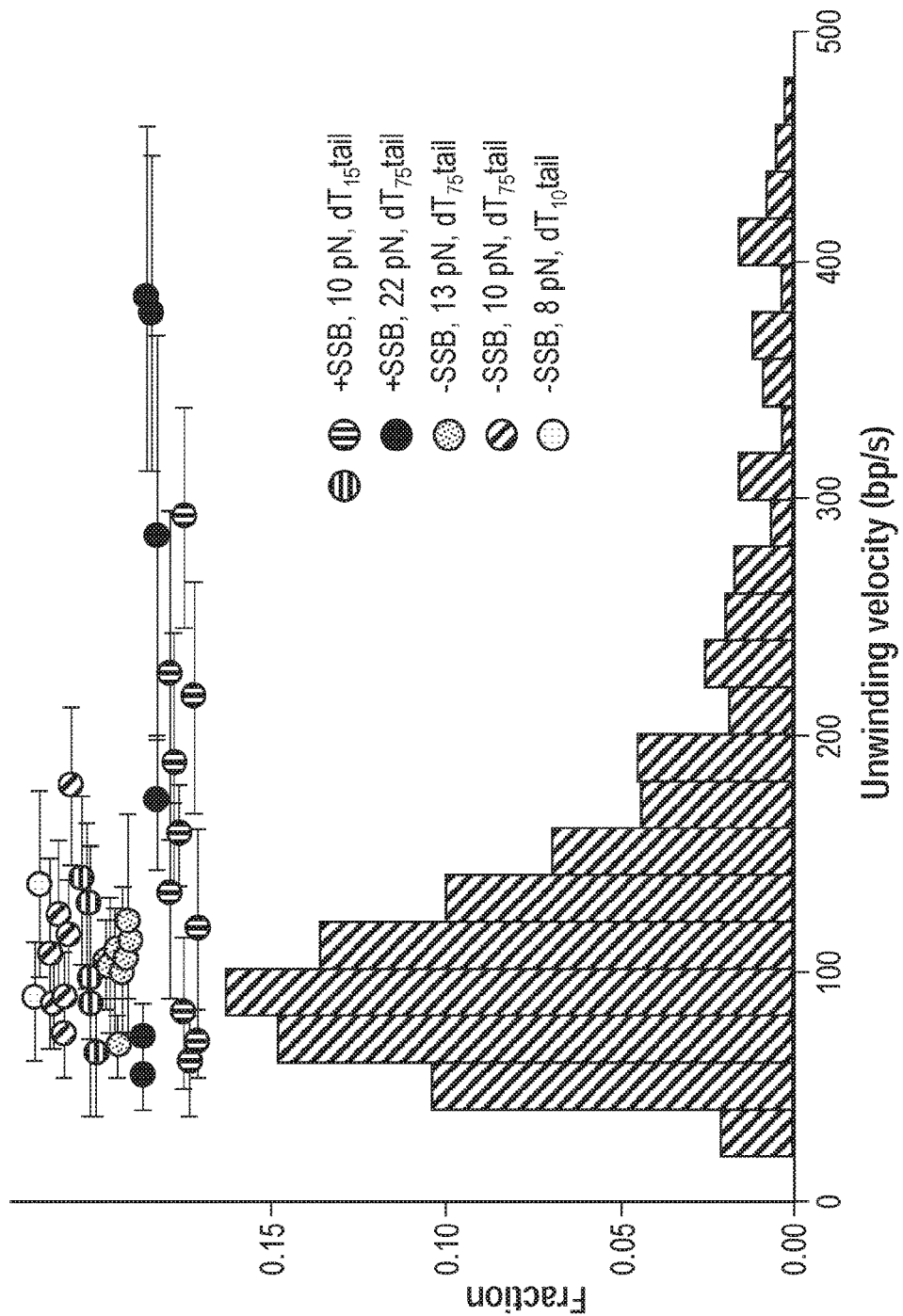

FIG. 3C depicts an exemplary distribution of Rep-X unwinding velocities (N=38). Mean velocity of unwinding and the standard deviation for each molecule were plotted above (colors as in B). Figure discloses "(dT)$_{10}$," "(dT)$_{15}$" and "(dT)$_{75}$" as SEQ ID NOS 33-35, respectively.

Figure 3D:
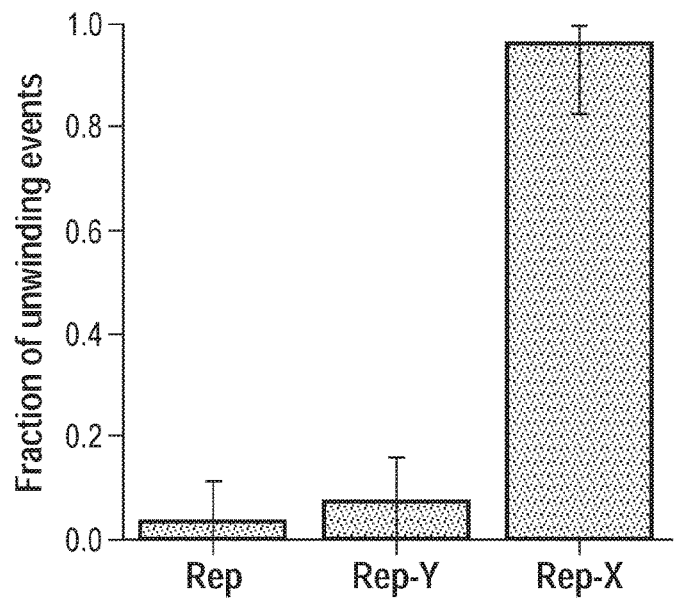

FIG. 3D depicts exemplary data comparing the fraction of the complete DNA binding events for Rep, Rep-Y and Rep-X. Error bars represent the 95% confidence bounds.

Figure 3E:
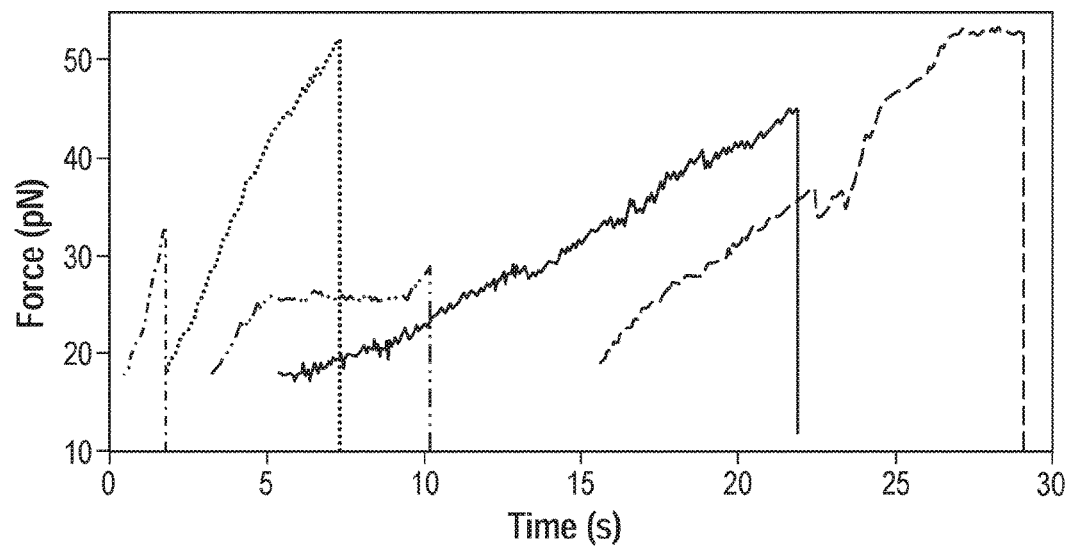

FIG. 3E depicts unwinding by five representative Rep-X molecules in the fixed trap assay are plotted. Pulling force increases during unwinding as the Rep-X pulls the beads closer. Tether breaks appear as sudden force drops.

Figure 3F:
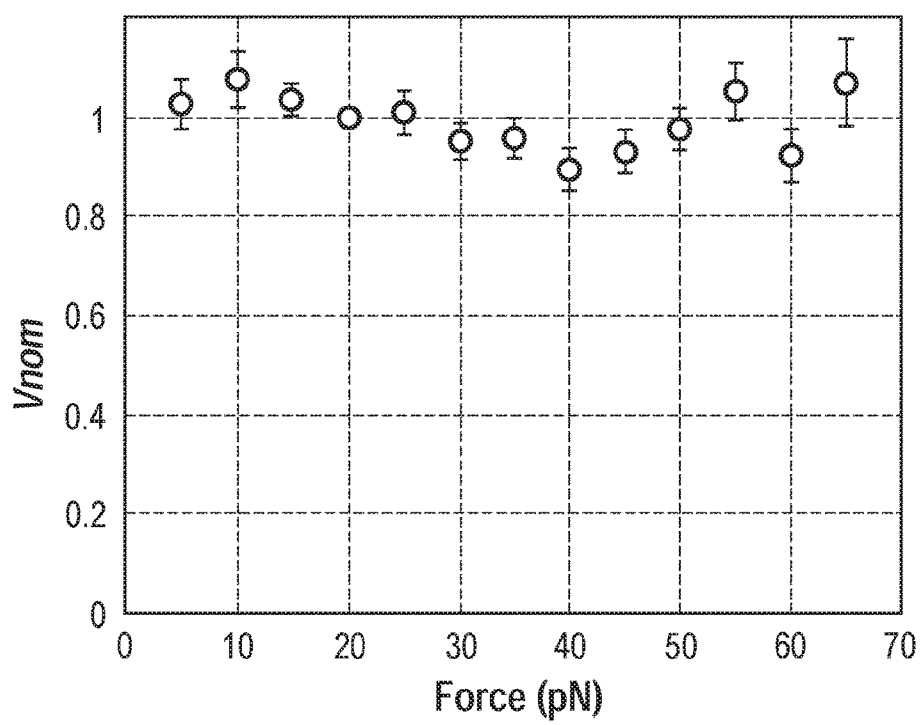

FIG. 3F depicts exemplary data showing the average of normalized unwinding velocities of 58 Rep-X molecules plotted against the pulling force that shows the high force tolerance of the engineered super-helicase Rep-X. Error bars represent standard error of the mean.

FIG. 4A illustrates a consensus sequence alignment of TxGx motif for 27 organisms within 10 out 11 families, wherein Cys is present at position 96. Leuconostocaceae family species have an alanine at this position. Figure discloses SEQ ID NOS 109-142, respectively, in order of appearance.

FIG. 4B illustrates a consensus sequence alignment of motif III for 27 organisms within 10 families, wherein Cys is present at position 247. Leuconostocaceae family species have an alanine at this position. Figure discloses SEQ ID NOS 143-176, respectively, in order of appearance.

Figure 5A:
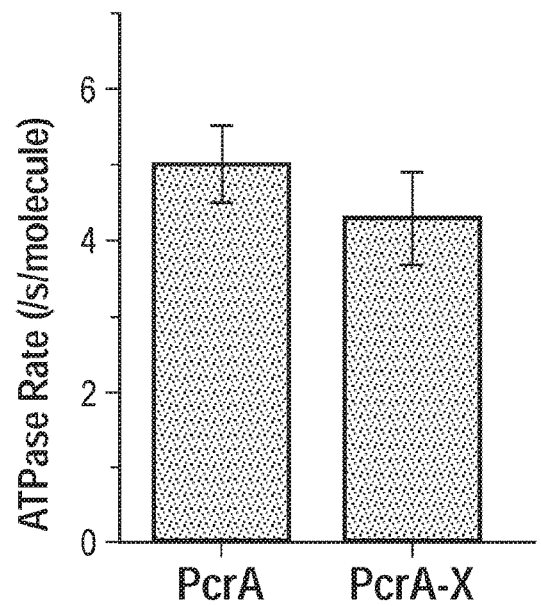

FIG. 5A depicts exemplary ATPase activity of mutant PcrA before ("PcrA") and after crosslinking ("PcrA-X"). Error bars represent standard deviation over multiple preparations.

Figure 5B:
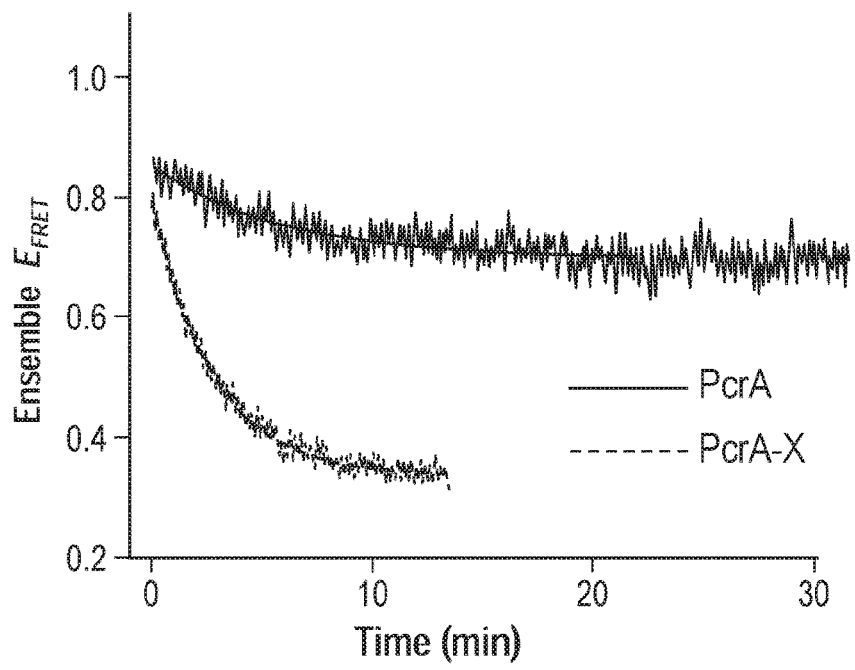

FIG. 5B depicts exemplary data of an ensemble unwinding assay for PcrA-X and wild type PcrA. Solid lines are fitted exponential decay curves as visual guides.

Figure 6A:
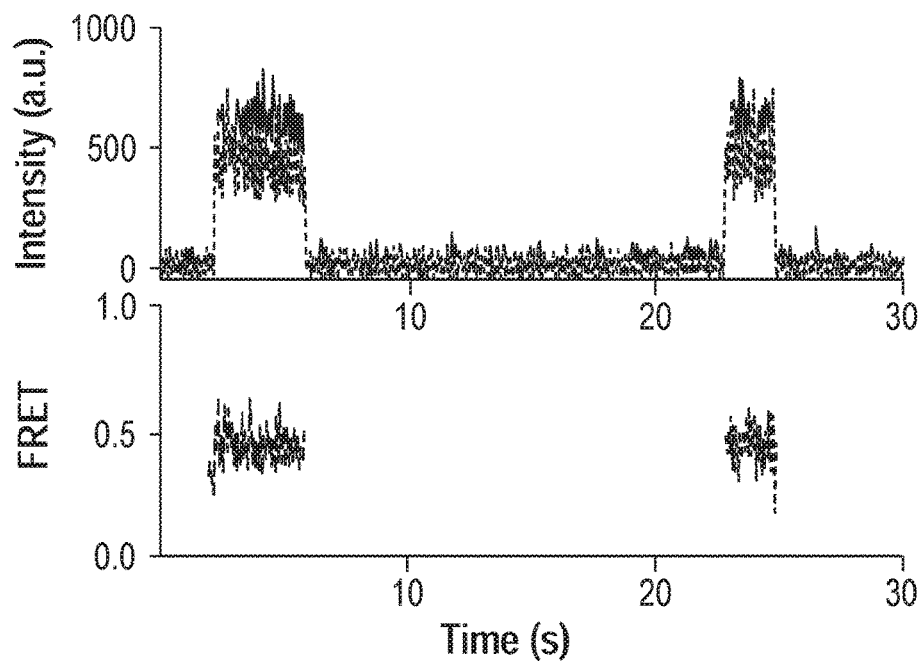

FIG. 6A depicts representative single molecule time traces for DNA binding and unwinding by PcrA-X monomers.

Figure 6B:
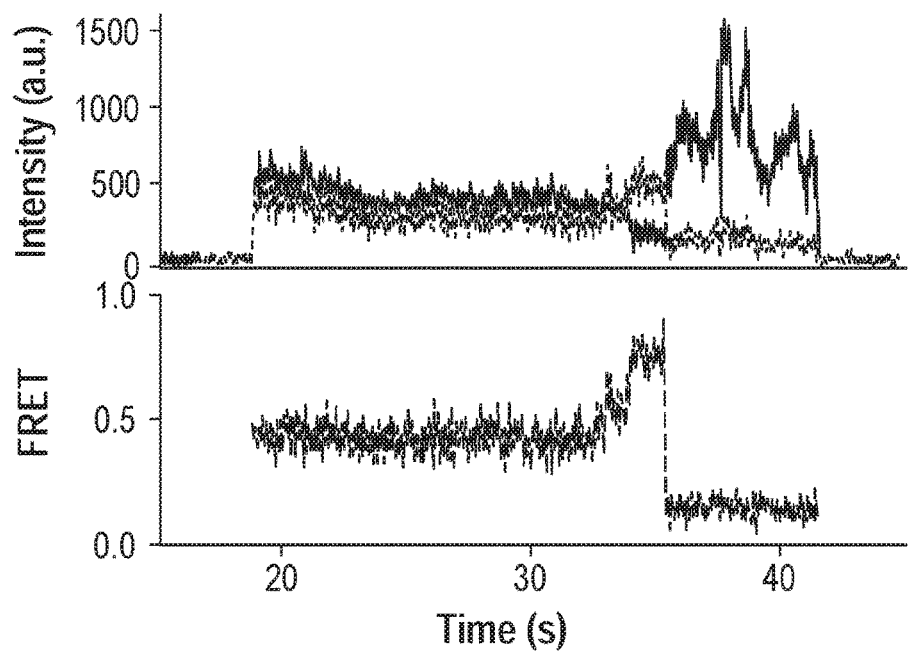

FIG. 6B depicts representative single molecule time traces for DNA binding and unwinding by t PcrA monomers, which are incapable of DNA unwinding.

Figure 6C:
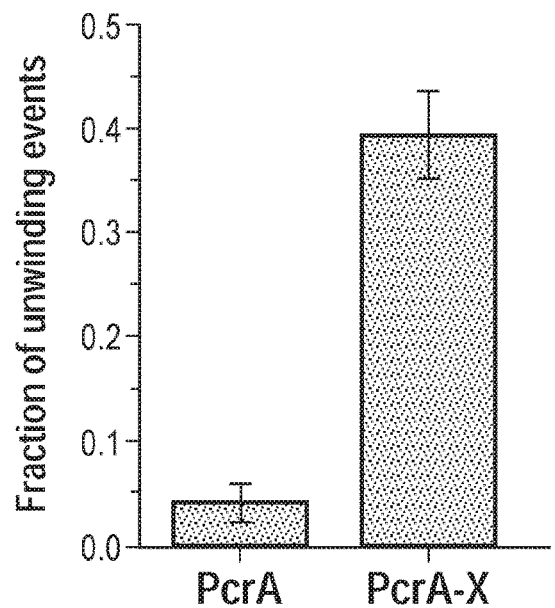
Figure 6D:
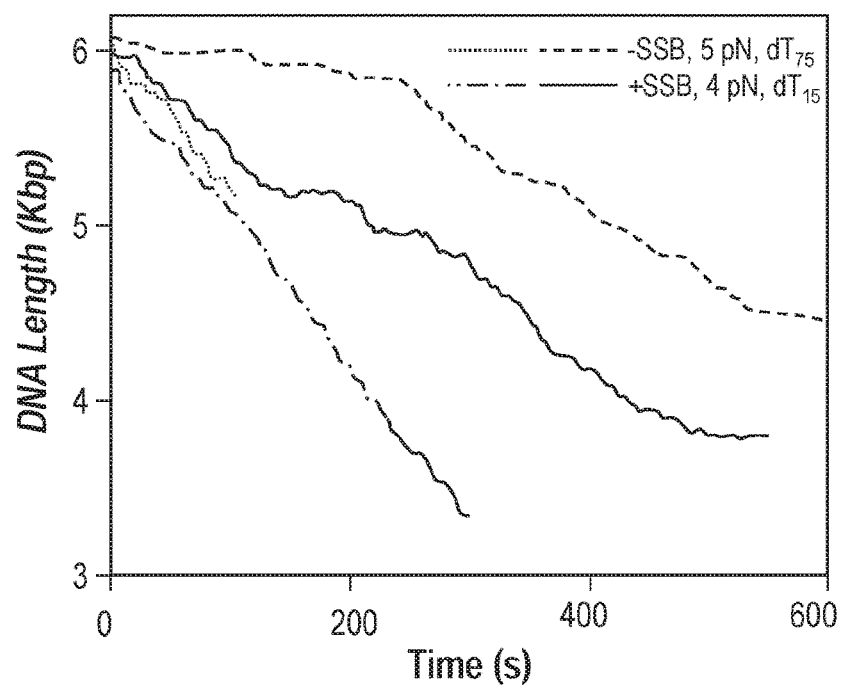

FIG. 6C depicts exemplary data of fractions of enzyme-DNA binding events that led to an unwinding phase fix PcrA and PcrA-X in the smFRET assay. Error bars represent the 95% confidence bounds FIG. 6D depicts exemplary data showing processive unwinding of 6-kbp DNA by four representative PcrA-X molecules in the optical tweezers assay. Figure discloses "(dT)$_{15}$" and "(dT)$_{75}$" as SEQ ID NOS 34 and 35, respectively.

Figure 6E:
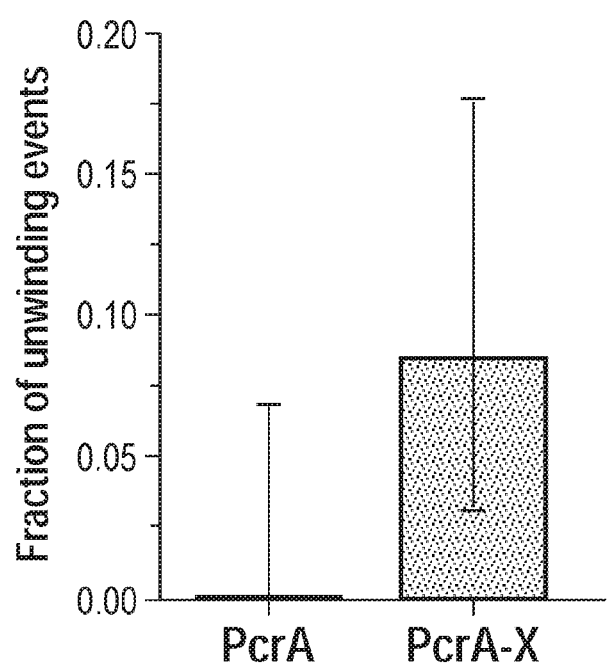
Figure 6F:
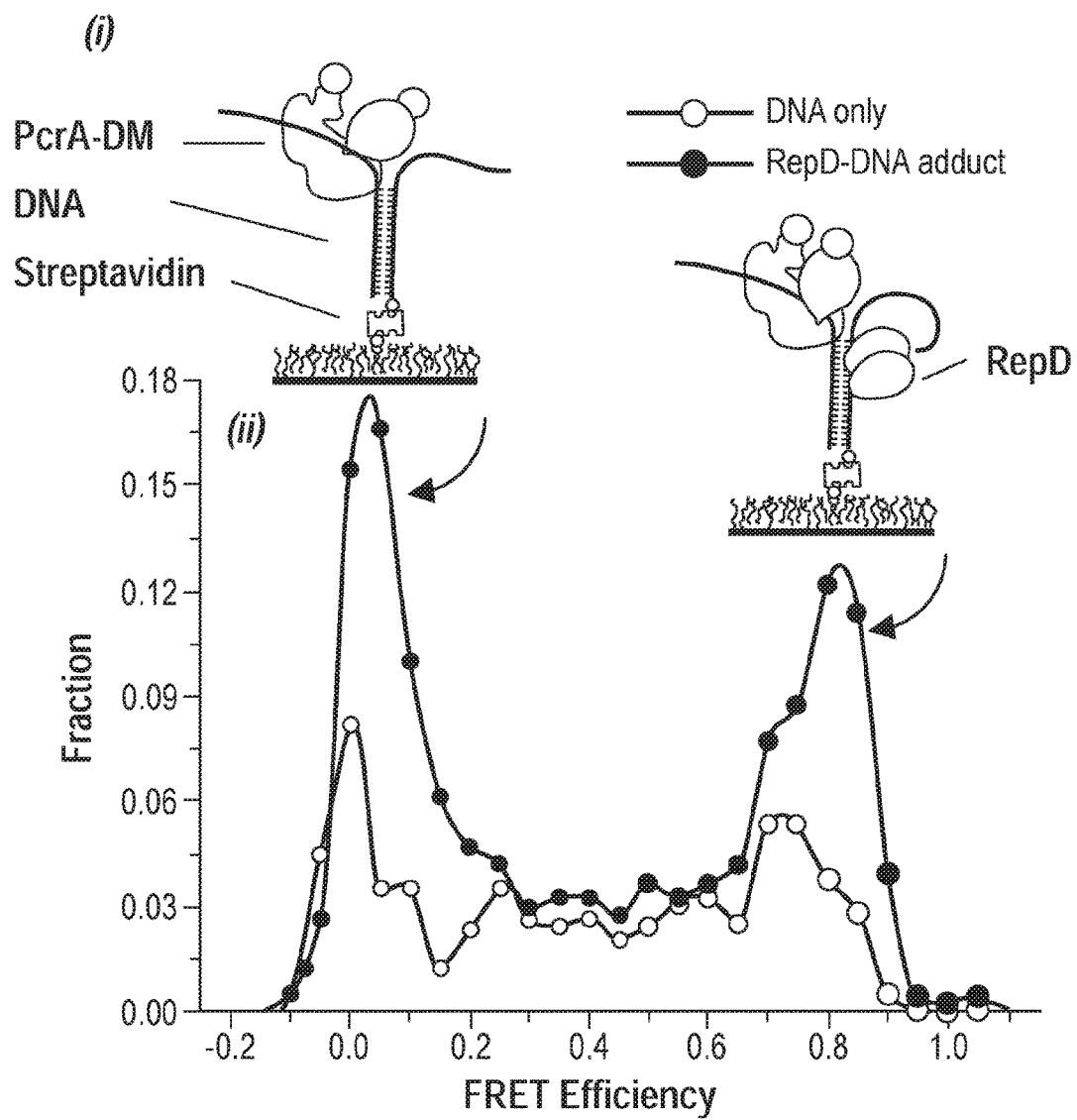

FIG. 6E depicts exemplary data for fractions of enzyme-DNA binding that led to the unwinding of 6-kbp DNA in the optical tweezers assay. Error bars represent the 95% confidence bounds FIG. 6F depicts a schematic (in subpanel (i)) of the conformational effect of RepD, a stimulatory partner of PcrA, on PcrA as measured in a smFRET assay and $E_{FRET}$ histograms (sub-panel (ii)) showing that the PcrA bound to RepD adduct is biased toward the closed form (high $E_{FRET}$ population) compared to PcrA bound to the bare ori-D DNA.

Figure 7A:
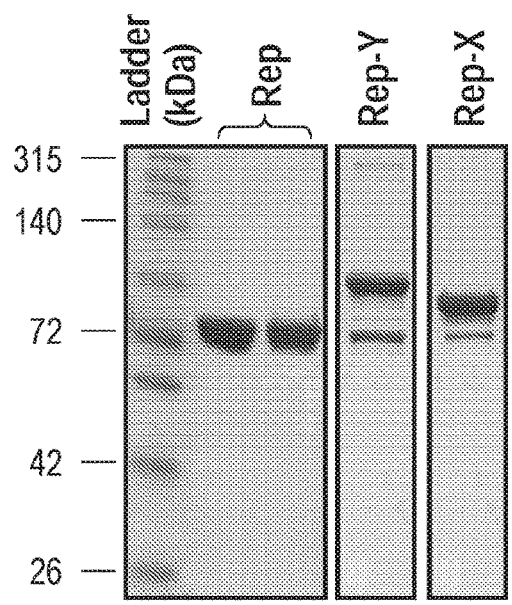

FIG. 7A shows an exemplary SDS-PAGE analysis of Rep-Y intra-crosslinking, wherein the typical three-band pattern on SDS polyacrylamide gels is evident. Rep-X intra-crosslinking pattern is shown for comparison, wherein the dominant middle band is slightly shifted for Rep-X compared with the corresponding band for Rep-Y. Lane designated as Rep is non-crosslinked Rep.

Figure 7B:
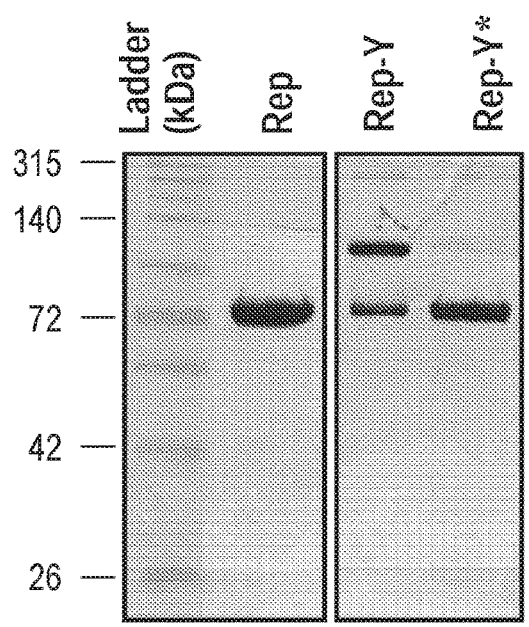

FIG. 7B shows an exemplary SDS-PAGE analysis of Rep-Y intra-crosslinking in comparison to uncrosslinked Rep ("Rep"). Lane denoted as Rep-Y* depicts β-ME reduced Rep-Y (crosslinked with a di-sulfide crosslinker DTME).

Figure 7C:
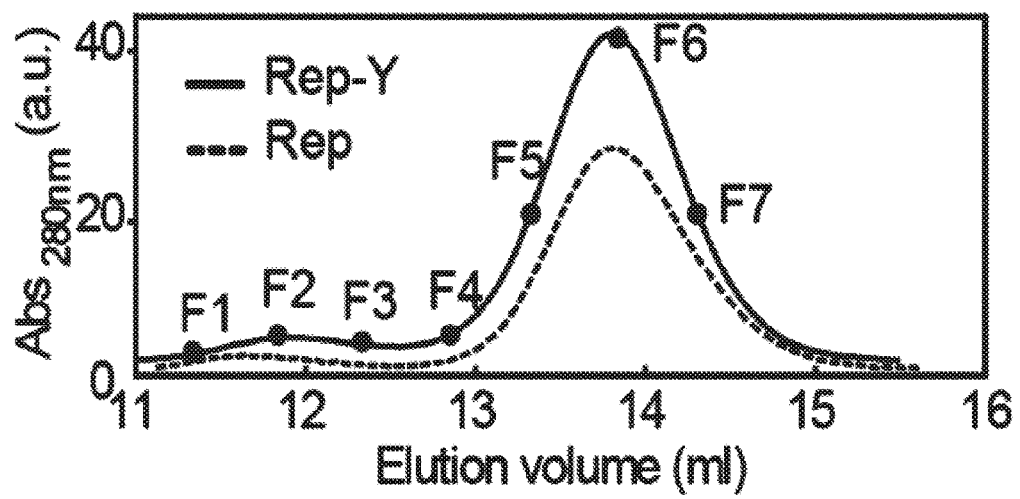

FIG. 7C shows an exemplary size exclusion chromatography (SEC) elution profile for Rep (dotted line) and the Rep-Y sample (solid line).

Figure 7D:
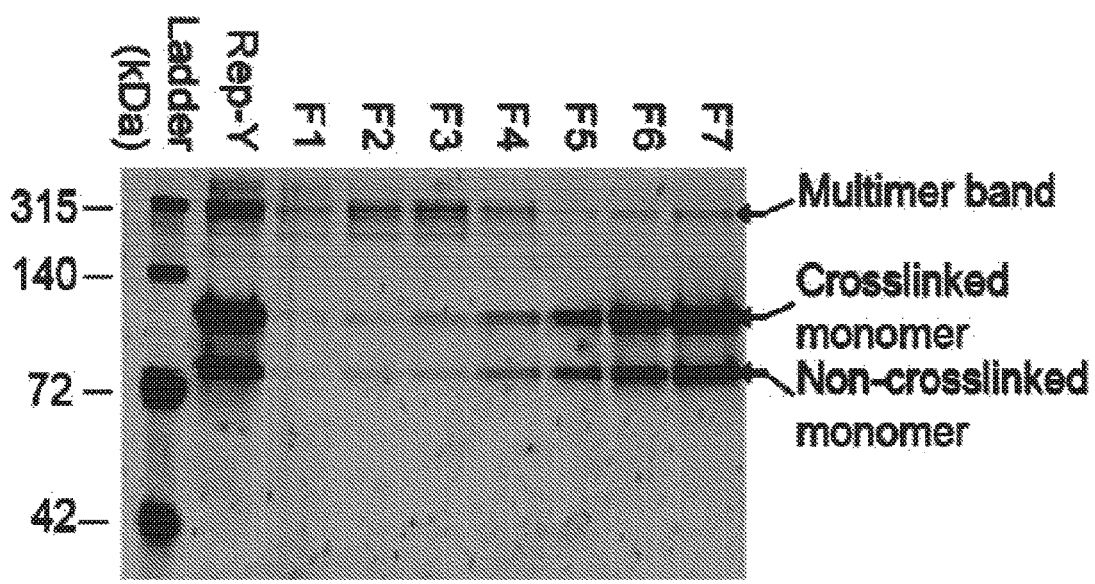

FIG. 7D shows an exemplary SDS-PAGE analysis of Rep-Y fractions, F1-F7, collected from SEC (FIG. 5C) in comparison with Rep-Y.

Figure 7E:
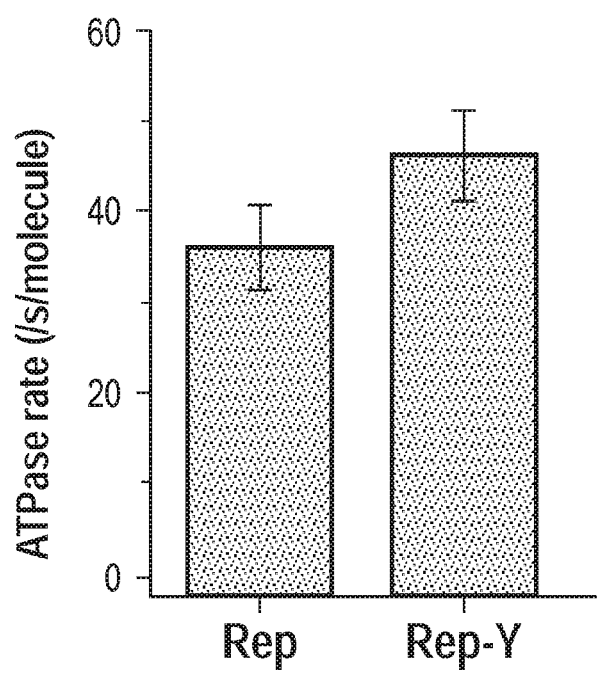

FIG. 7E depicts exemplary data of ssDNA dependent ATPase levels of Rep-Y and Rep. Error bars represent standard deviation over multiple preparations.

Figure 8:
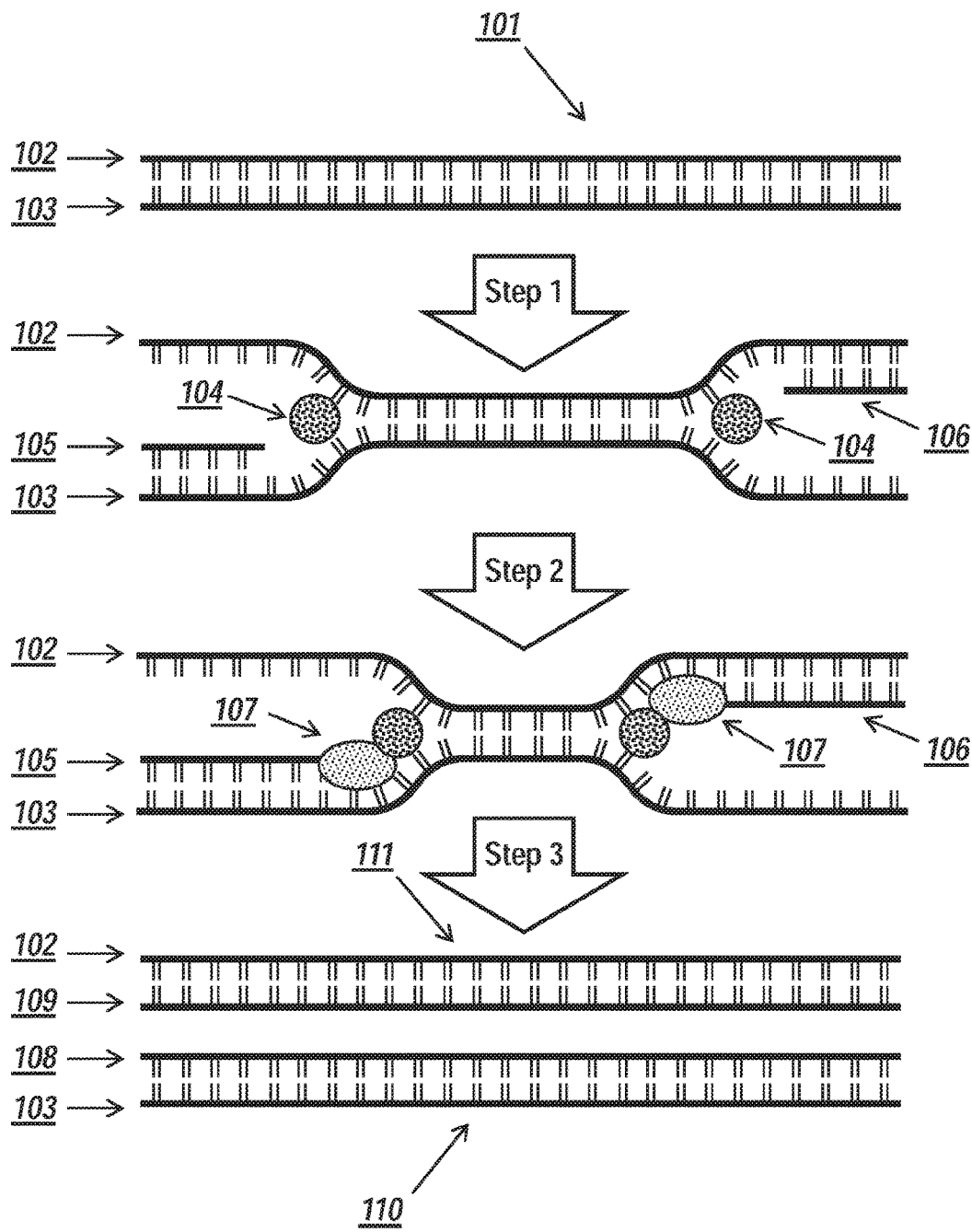

FIG. 8 depicts a schematic of an isothermal DNA amplification process called helicase dependent amplification, wherein in step 1: DNA helicase (104) contacts a double-stranded DNA (101) to unwind the first and second single strands (102 and 103) and first and second oligonucleotide primers (105 and 106) hybridize to the first and second single strands (102 and 103) respectively; in step 2: DNA-dependent DNA polymerases (107) bind to the 3'-termini of the first and second oligonucleotide primers (105 and 106) to initiate chain elongation of new strands (108 and 109);

and in step 3: continued DNA polymerization results in DNA amplification and formation of new double-stranded DNA (110 and 111).

FIG. 9A shows target residues in Rep (SEQ ID NO: 32), PcrA (SEQ ID NO: 177) and UvrD (SEQ ID NO: 178), for −X form crosslinking, calculated based on the criteria and crystal structures in open (inactive) and closed (active) conformations. One residue is chosen from 1A or 1B domain (shaded), and another from 2B (shaded).

FIG. 9B shows 56 representative Rep homologs/orthologs with 90% identity to and 80% overlap, and the corresponding region of domain 1A where crosslinking residues can be chosen. FIGS. 9B-9C disclose SEQ ID NOS 179-235, respectively, in order of appearance.

FIG. 9C shows 56 representative Rep homologs/orthologs with 90% identity to and 80% overlap, and the corresponding region of domain 1B where crosslinking residues can be chosen.

FIG. 9D shows 56 representative Rep homologs/orthologs with 90% identity to and 80% overlap, and the corresponding region of domain 2B where crosslinking residues can be chosen. FIGS. 9D-9F disclose SEQ ID NOS 236-292, respectively, in order of appearance.

FIG. 9E shows 56 representative Rep homologs/orthologs with 90% identity to and 80% overlap, and the corresponding region of domain 2B where crosslinking residues can be chosen in addition to those shown in FIG. 9D.

FIG. 9F shows 56 representative Rep homologs/orthologs with 90% identity to and 80% overlap, and the corresponding region of domain 2B where crosslinking residues can be chosen in addition to those shown in FIG. 9E.

FIG. 9G shows target residues in drUvrD, Rep, PcrA and UvrD, for −X form crosslinking, calculated based on the criteria and crystal structures in open (inactive) and closed (active) conformations. One residue is chosen from 1A or 1B domain (shaded), and another from 2B (shaded). Figure discloses SEQ ID NOS 293-304, respectively, in order of appearance.

Figure 10:
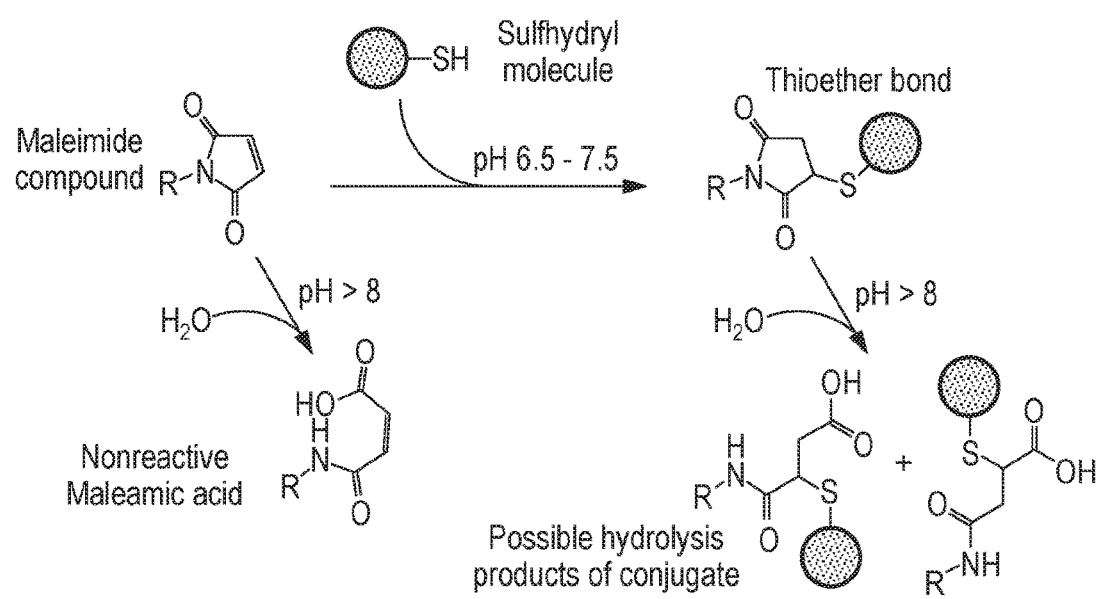

FIG. 10 shows the reaction of maleimide-activated compounds to sulfhydryl-bearing compounds.

Figure 11:
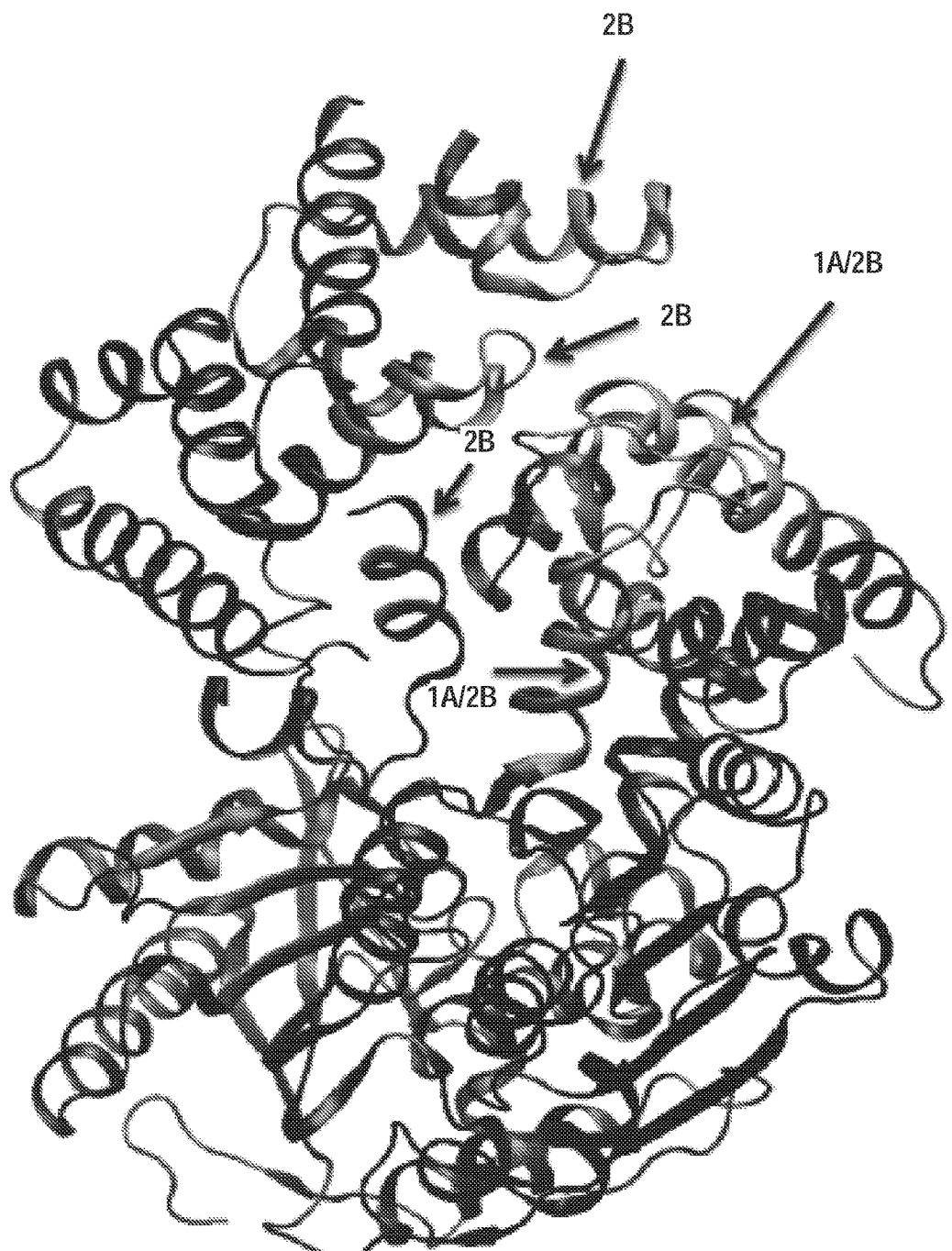

FIG. 11 shows a closed form crystal structure of *D. radiodurans* UvrD (drUvrD; Q9RTI9) with target crosslinking regions of domains 1A, 1B and 2B indicated by arrows.

Figure 12:
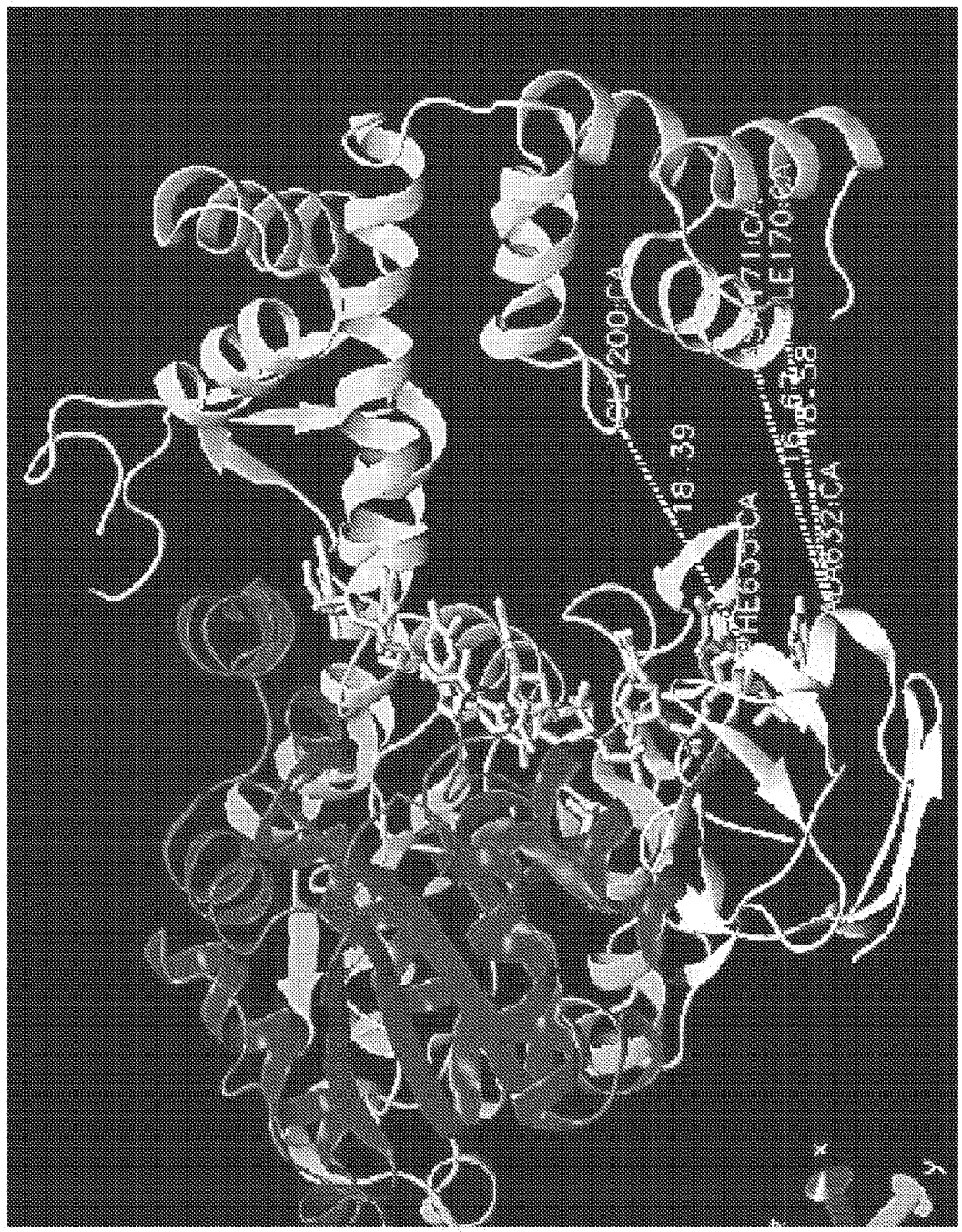

FIG. 12 shows selected target residue pairs for crosslinking, and the specific distances between the pairs, in a ribbon diagram of a structure of RecD2.

Figure 13:
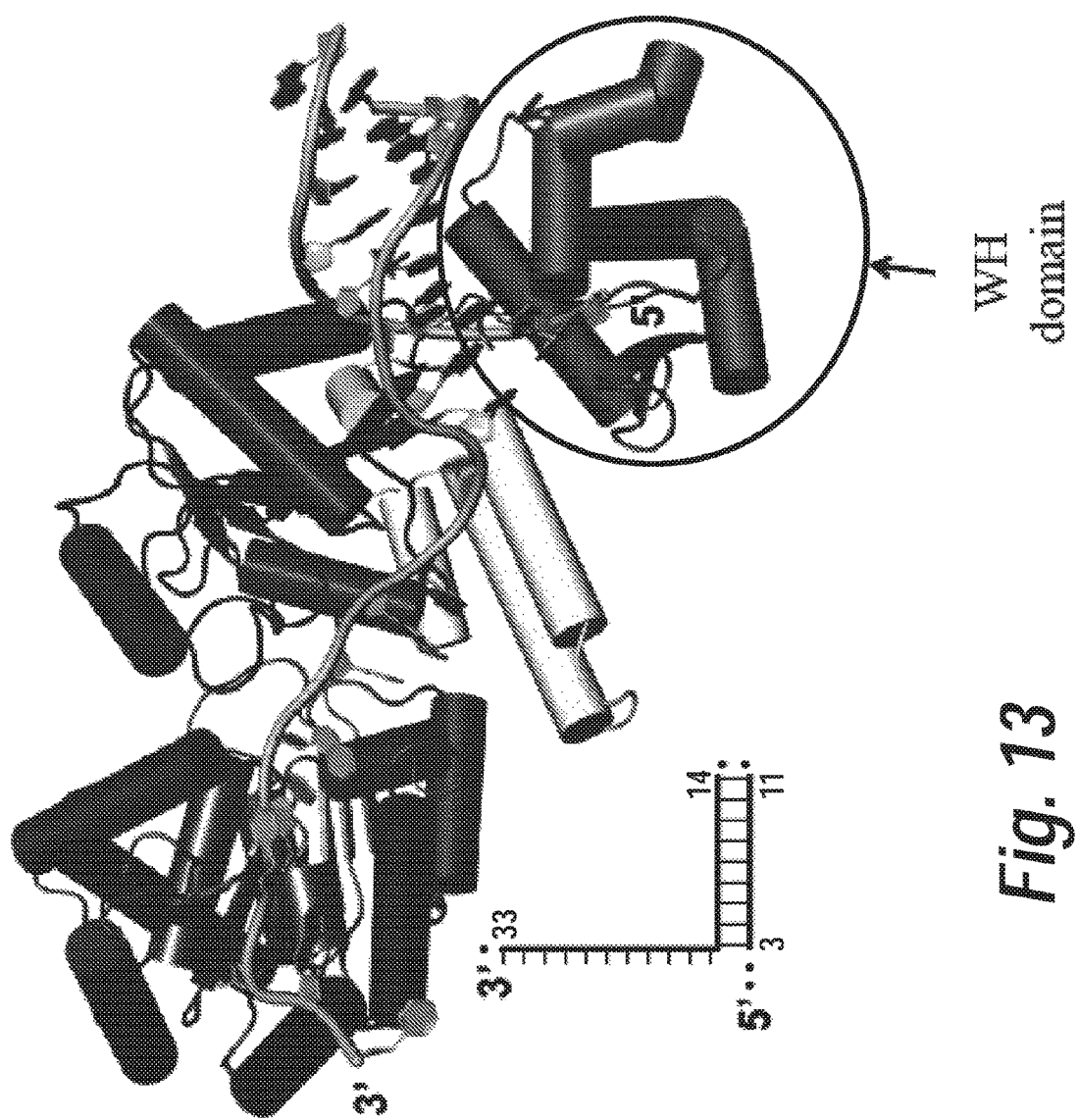

FIG. 13 is a ribbon diagram of a CsRecQ/DNA crystal structure.

Figure 14:
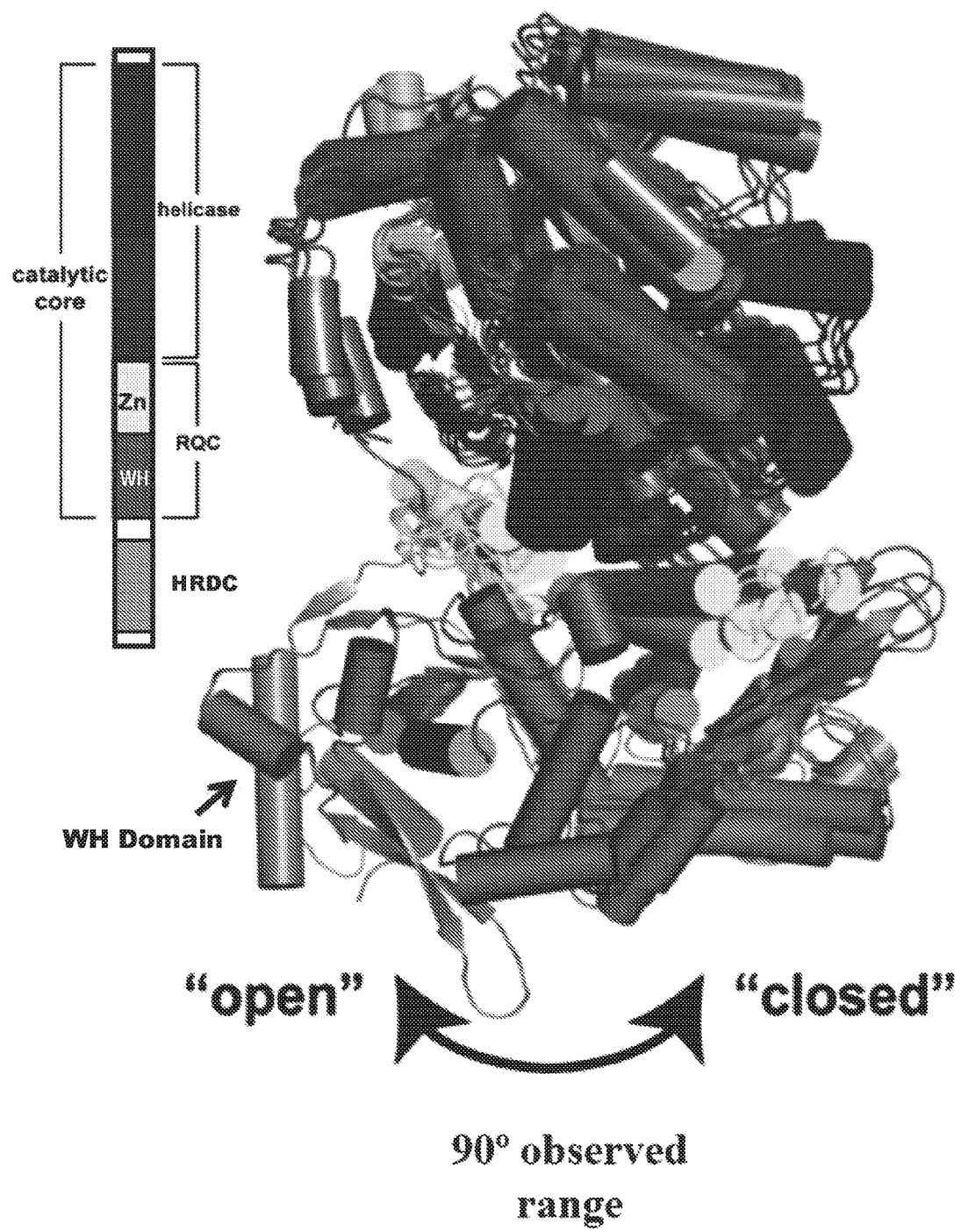

FIG. 14 shows a schematic diagram of RecQ DNA helicase, and an overlay of RecQ structures which highlight the mobility of the WH domain.

Figure 15:
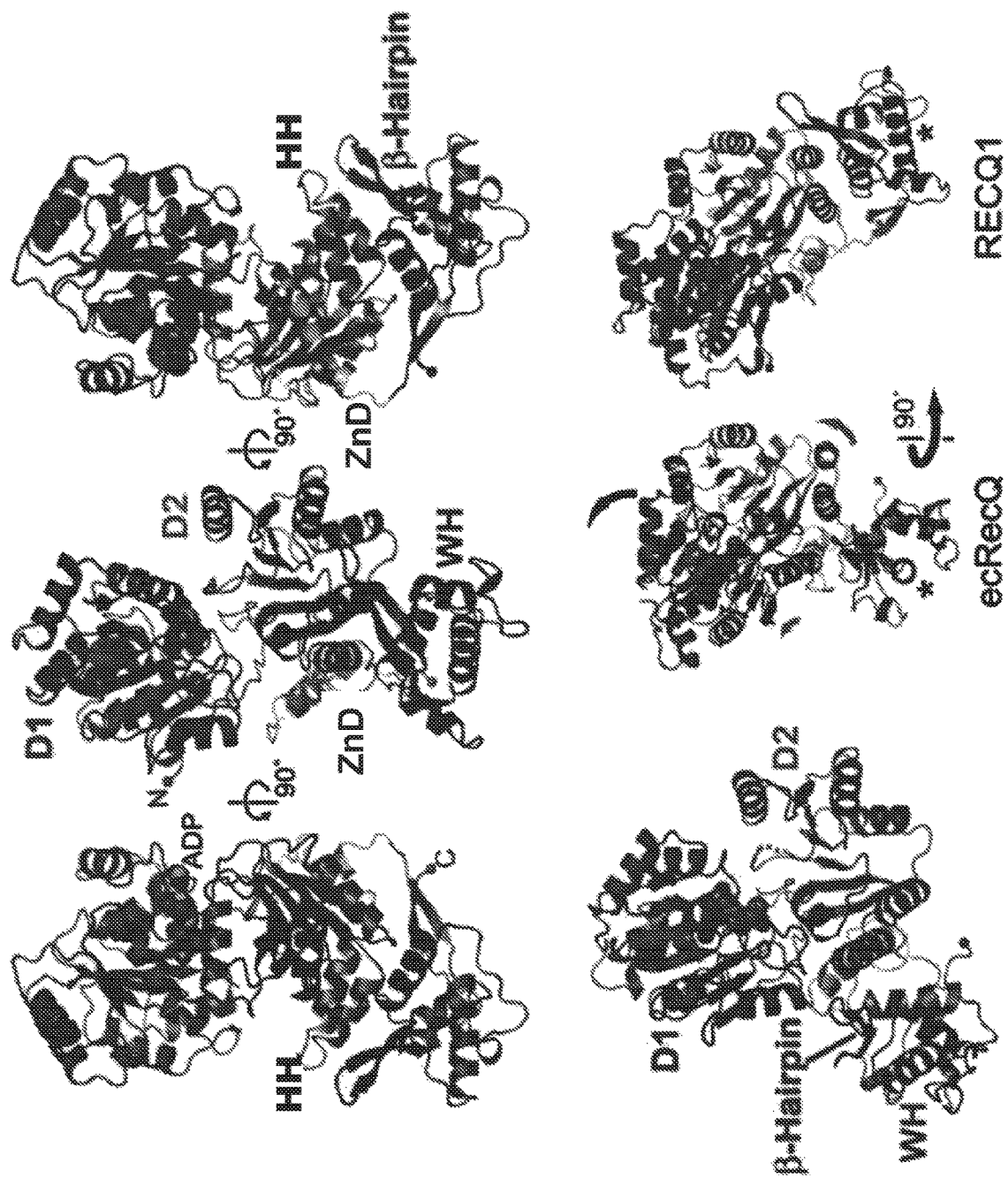

FIG. 15 shows alternate ribbon diagrams of a RecQ1 crystal structure.

FIG. 16 shows a stereo view of a ribbon diagram of a 5'-3' SF1 superhelicase (T4 Dda).

Figure 17:
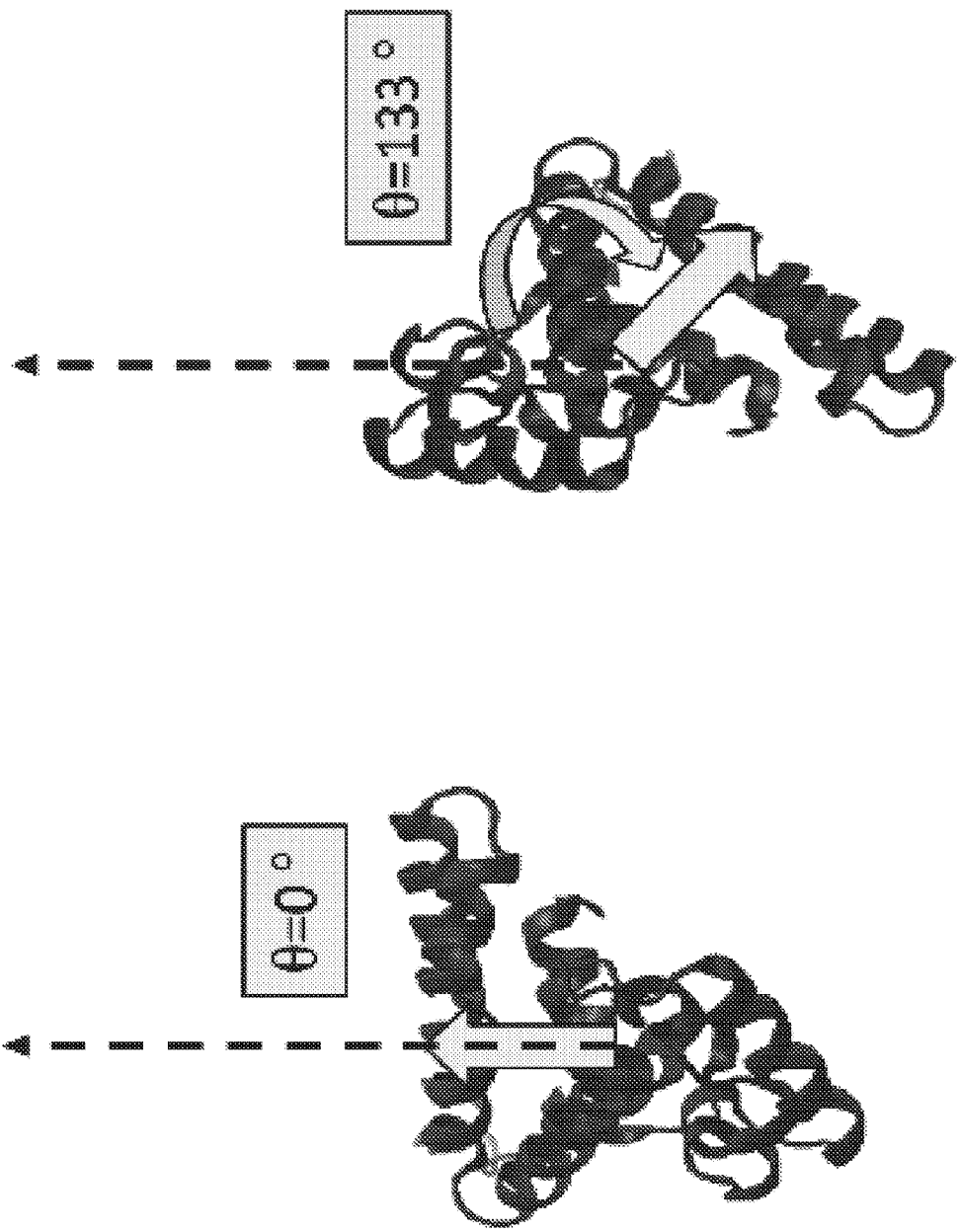

FIG. 17 shows Rep helicase's 2B domain structure in two different orientations that differ through a rotation around an axis coming out of the plane of the paper. 2B domain orientation can be described by the rotation angle θ with respect to the closed form. θ=0 when the helicase is in the closed form, and θ is 133 degrees when the 2B rotates to the open form.

DETAILED DESCRIPTION

The present disclosure provides details of the discovery of robust enzymes of the superfamily 1 helicases. The helicase enzymes are engineered as crosslinked, conformationally-constrained monomeric configurations providing enhanced unwinding activity on dsDNA substrates. The "super" helicases display inherently strong physical properties having superior characteristics to all presently known natural helicases. The disclosed helicases have utility in isothermal PCR and helicase-dependent amplification processes, as well as in next generation sequencing applications, including nanopore sequencing methods and the like.

Terminology and Definitions

The terminology used herein is for the purpose of describing particular embodiments only, and is not intended to be limiting. With respect to the use of plural and/or singular toms herein, those having skill in the art can translate from the plural as is appropriate to the context and/or application. The various singular/plural permutations may be expressly set forth herein for the sake of clarity.

Terms used herein are intended as "open" terms (e.g., the term "including" should be interpreted as "including but not limited to," the term "having" should be interpreted as "having at least," the term "includes" should be interpreted as "includes but is not limited to," etc.).

Furthermore, in those instances where a convention analogous to "at least one of A, B and C, etc." is used, in general such a construction is intended in the sense of one having ordinary skill in the art would understand the convention (e.g., "a system having at least one of A, B and C" would include but not be limited to systems that have A alone, B alone, C alone, A and B together, A and C together, B and C together, and/or A, B, and C together). It will be further understood by those within the art that virtually any disjunctive word and/or phrase presenting two or more alternative terms, whether in the description or figures, should be understood to contemplate the possibilities of including one of the terms, either of the terms, or both terms. For example, the phrase "A or B" will be understood to include the possibilities of "A" or 'B or "A and B."

All language such as "up to," "at least," "greater than," "less than," and the like, include the number recited and refer to ranges which can subsequently be broken down into sub-ranges.

A range includes each individual member. Thus, for example, a group having 1-3 members refers to groups having 1, 2, or 3 members. Similarly, a group having 1-6 members refers to groups having 1, 2, 3, 4, or 6 members, and so forth.

The modal verb "may" refers to the preferred use or selection of one or more options or choices among the several described embodiments or features contained within the same. Where no options or choices are disclosed regarding a particular embodiment or feature contained in the same, the modal verb "may" refers to an affirmative act regarding how to make or use and aspect of a described embodiment or feature contained in the same, or a definitive decision to use a specific skill regarding a described embodiment or feature contained in the same. In this latter context, the modal verb "may" has the same meaning and connotation as the auxiliary verb "can."

The present invention provides modified helicases that have enhanced enzymatic activity. As used herein, a "helicase" refers to a class of enzymes that function as motor proteins which move directionally along a nucleic acid phosphodiester backbone, separating two annealed nucleic acid strands (i.e., DNA, RNA, or RNA-DNA hybrid) using energy derived from ATP hydrolysis. Helicases are often used to separate strands of a DNA double helix or a self-annealed RNA molecule using the energy from ATP hydrolysis, a process characterized by the breaking of hydrogen bonds between annealed nucleotide bases. They also function to remove nucleic acid-associated proteins and catalyze homologous DNA recombination. Metabolic processes of RNA such as translation, transcription, ribosome biogenesis, RNA splicing, RNA transport, RNA editing, and RNA degradation are all facilitated by helicases. Helicases move incrementally along one nucleic acid strand of the duplex with a directionality and processivity specific to each particular enzyme.

Six super families of helicases are known in the art that are classified based on their shared sequence motifs. Helicases not forming a ring structure are classified in Super Families 1 (SF1) and 2 (SF2). Ring-forming helicases form Super Families 3 (SF3), 4 (SF4), 5 (SF5) and 6 (SF6).

SF1 is further subdivided into SF1A and SF1B helicases. In this group, helicases can have either 3'-5' (SF1A subfamily) or 5'-3'(SF1B subfamily) translocation polarity. SF1A helicases include, but are not limited to are Rep and UvrD in gram-negative bacteria and PcrA helicase from gram-positive bacteria. SF1B helicases include, but are not limited to RecD and Dda helicases.

SF2 is the largest family of helicases, which are involved in varied cellular processes. They are characterized by the presence of nine conserved motifs: Q, I, Ia, Ib, and II through VI. This family primarily comprises DEAD-box RNA helicases ("DEAD" disclosed as SEQ ID NO: 18). Other helicases in SF2 family are the RecQ-like family and Snf2-like enzymes. Most of the SF2 helicases are type A, with a few exceptions such as the XPD family.

SF3 comprises helicases encoded mainly by small DNA viruses and some large nucleocytoplasmic DNA viruses. They have a 3'-5' translocation directionality (therefore they are all type A helicases). SF3 helicase include viral helicases such as the papilloma virus E1 helicase.

SF4 helicases have a type B polarity (5'-3'), and function in bacterial or bacteriophage DNA replication. Gp4 from bacteriophage T7 is an SF4 helicase.

SF5 helicases have a type B polarity (5'-3'), and include only the bacterial termination factors Rho.

SF6 helicases contain the core AAA+ that is not included in the SF3 classification. SF6 helicases include, but are not limited to, Mini Chromosome Maintenance (MCM), RuvB, RuvA, and RuvC.

Exemplary helicases according to the invention include, but are not limited to RecD, Upf1, PcrA, Rep, UvrD, Hel308, Mtr4, XPD, NS3, Mss1 16, Prp43, RecG, RecQ, TIR, RapA, Hef, RecB, Pif1, Dna2, Dda, Ul5, RecD2, Tral, Sen1p, SETX, IBP160, ZNFX1, Upf1p, UPF1, Hcs1p, IGHMBP2, Dna2p, DNA2, Mtt1p, MOV10, MOV10L1, HELZ, PR285, ptMRDFL1 and the like.

In certain embodiments of the invention, a helicase comprises subdomains. For example, SF1 helicases comprise subdomains 1A, 1B, 2A and 2B. The 2B subdomain has been shown to rotate between an open conformation and a closed conformation.

As used herein, an "open conformation" refers to the inactive conformation of a helicase in which minimal or no helicase activity occurs. As used herein, a "closed conformation" refers to the active form of a helicase which has helicase activity. Crystal structures depicting the open and/or closed conformations of many helicases have been published in the art.

As described further herein, it has been discovered that, by stabilizing the active (i.e., closed) conformation and destabilizing the inactive (i.e., open) conformation, a modified helicase can be obtained having greatly enhanced helicase activity and strength relative to the corresponding unmodified helicase. According to certain embodiments of the invention, a modified helicase that stabilizes the active (i.e., closed) conformation and destabilizes the inactive (i.e., open) conformation can be generated by covalently linking one or more amino acids in the 2B subdomain to one or more amino acids in the 1A and/or the 1B domain of the helicase. Such a modified helicase is referred to herein as an "active, conformationally constrained helicase" or a "helicase-$_X$ polypeptide." Exemplary helicase-$_X$ polypeptides include, but are not limited to, Rep-$_X$, PcrA-$_X$ and UvrD-$_X$. In certain embodiments, a helicase-$_X$ polypeptide forms a loop around a target nucleic acid sequence (e.g., a DNA sequence) In other embodiments, a helicase-$_X$ polypeptide does not form a loop around a target nucleic acid sequence (e.g., a DNA sequence).

In other embodiments, a helicase is provided that is stabilized in its inactive (i.e., open) conformation and destabilized in its active (i.e., closed) conformation. Such a helicase is referred to as an "inactive, conformationally constrained helicase" or a "helicase-$_Y$ polypeptide." Helicase-$_Y$ polypeptides exhibit little or no helicase activity.

In certain embodiments, a helicase-$_X$ polypeptide has an increased nucleic acid (e.g., DNA) unwinding activity relative to a corresponding unmodified helicase. In certain aspects, the number of base pairs that can be unwound by a helicase-$_X$ polypeptide is increased by about 1000%, about 10,000%, about 100,000% or more (or any ranges or points within the ranges) relative to a corresponding unmodified helicase.

In certain embodiments, a helicase-$_X$ polypeptide can unwind at least about 500 base pairs, about 1000 base pairs, about 1500 base pairs, about 2000 base pairs, about 2500 base pairs, about 3000 base pairs, about 3500 base pairs, about 4000 base pairs, about 4500 base pairs, about 5000 base pairs, about 5500 base pairs, about 6000 base pairs, about 6500 base pairs, about 7000 base pairs, about 7500 base pairs, about 8000 base pairs, about 8500 base pairs, about 9000 base pairs, about 9500 base pairs, about 10,000 base pairs or more (or any ranges or points within the ranges) without dissociating from the nucleic acid sequence (e.g., DNA).

In certain embodiments, a helicase-$_X$ polypeptide is stronger that the corresponding unmodified helicase, withstanding opposing forces of at least about 10 pN, about 15 pN, about 20 pN, about 25 pN, about 30 pN, about 35 pN, about 40 pN, about 45 pN, about 50 pN, about 55 pN, about 60 pN, or more (or any ranges or points within the ranges).

In certain embodiments, a helicase-$_X$ polypeptide comprises a first subdomain comprising a first amino acid and a second subdomain comprising a second amino acid, wherein the first amino acid is at least about 35 Å from the second amino acid when the helicase is in an inactive conformation, and wherein the first amino acid is less than about 25 Å from the second amino acid when the helicase is in an active conformation. In certain embodiments, the first amino acid is at least about 40 Å, about 45 Å, about 50 Å, about 55 Å, about 60 Å, about 65 Å, about 70 Å, about 75 Å, about 80 Å, about 85 Å, or more from the second amino acid (or any ranges or points within these ranges) when the helicase is in an inactive (i.e., open) conformation. In certain embodiments, the first amino acid is at most about 20 Å, about 15 Å, about 10 Å, about 9 Å, about 8 Å, about 7 Å, about 6 Å, about 5 Å, about 4 Å, or less from the second amino acid (or any ranges or points within the ranges) when the helicase is in an active (i.e., closed) conformation. In certain embodiments, the linker in a helicase$_X$ polypeptide has a length in the range from about 6 Å to about 25 Å.

In certain embodiments, the first amino acid of a helicase-$_X$ polypeptide is present in a 1A or a 1B subdomain and the second amino acid of a helicase$_X$ polypeptide is present in a 2B subdomain.

In certain embodiments, the Rep-$_X$ polypeptide forms a loop around the target nucleic acid (e.g., DNA) sequence. In certain embodiments, the first amino acid of a Rep-$_X$ polypeptide that forms a loop is at any one of positions 84-108 or 169-187, or at position 178 of the Rep amino acid sequence. In certain embodiments, the second amino acid of a Rep$_X$ polypeptide that forms a loop is at any one of positions 388-402, 422-435 or 519-536, or at position 400 of the Rep amino acid sequence.

In certain embodiments, the PcrA-$_X$ polypeptide forms a loop around the target nucleic acid (e.g., DNA) sequence. In certain embodiments, the first amino acid of a PcrA-$_X$ polypeptide that forms a loop is at any one of positions 92-116 or 178-196, or at position 187 of the PcrA amino acid sequence. In certain embodiments, the second amino acid of a PcrA-$_X$ polypeptide that forms a loop is at any one of positions 397-411, 431-444 or 526-540, or at position 409 of the PcrA amino acid sequence.

In certain embodiments, the UvrD-$_X$ polypeptide forms a loop around the target nucleic acid (e.g., DNA) sequence. In certain embodiments, the first amino acid of a UvrD-$_X$ polypeptide that forms a loop is at any one of positions 90-114 or 175-193 of the UvrD amino acid sequence. In certain embodiments, the second amino acid of a UvrD-$_X$ polypeptide that forms a loop is at any one of positions 393-407, 427-440 or 523-540 of the UvrD amino acid sequence.

In certain embodiments, the Rep-$_X$ polypeptide does not form a loop around the target nucleic acid (e.g., DNA) sequence. In certain embodiments, the first amino acid of the Rep-$_X$ polypeptide that does not form a loop is at any one of positions 60-82 (i.e., at any one of AREMKERVGQTLGRKEARGLMIS (SEQ ID NO: 19)), or at any one of positions 68-79 (i.e., at any one of GQTLGRKEARGL (SEQ ID NO: 20)) of the Rep amino acid sequence. In certain embodiments, the second amino acid of the Rep-$_X$ polypeptide that does not form a loop is at any one of positions 509-536 (i.e., at any one of FSWMTEMLEGSELDEPMTLTQVVTRFTL (SEQ ID NO: 21)), or at any one of positions 519-525 (i.e., at any one of SELDEPM (SEQ ID NO: 22)) of the Rep amino acid sequence.

In certain embodiments, the PcrA-$_X$ polypeptide does not form a loop around the target nucleic acid (e.g., DNA) sequence. In certain embodiments, the first amino acid of the PcrA-$_X$ polypeptide that does not form a loop is at any one of positions 69-89 (i.e., at any one of AREMRERVQSLLGGAAEDVWI (SEQ ID NO: 23)), or at any one of positions 77-87 (i.e., at any one of QSLLGGAAEDV (SEQ ID NO: 24)) of the PcrA amino acid sequence. In certain embodiments, the second amino acid of the PcrA-$_X$ polypeptide that does not form a loop is at any one of positions 516-534 (i.e., at any one of LSVTKHFENVSDDKSLIAF (SEQ ID NO: 25)), or at any one of positions 526-532 (i.e., at any one of SDDKSLI (SEQ ID NO: 26)) of the PcrA amino acid sequence.

In certain embodiments, the UvrD-$_X$ polypeptide does not form a loop around the target nucleic acid (e.g., DNA) sequence. In certain embodiments, the first amino acid of the UvrD-$_X$ polypeptide that does not form a loop is at any one of positions 67-87 (i.e., at any one of AAEMRHRIGQLMGTSQGGMWV (SEQ ID NO: 27)), or at any one of positions 75-85 (i.e., at any one of GQLMGTSQGGM (SEQ ID NO: 28)) of the UvrD amino acid sequence. In certain embodiments, the second amino acid of the UvrD-$_X$ polypeptide that does not form a loop is at any one of positions 513-531 (i.e., at any one of VTATRQFSYNEEDEDLMPL (SEQ ID NO: 29)), or at any one of positions 523-529 (i.e., at any one of EEDEDLM (SEQ ID NO: 30)) of the UvrD amino acid sequence.

In certain embodiments, the first amino acid and/or the second amino acid of a helicase-$_X$ polypeptide is present in a particular amino acid sequence having at least about 15%, about 20%, about 25%, about 30%, about 35%, about 40%, about 45 about 50%, about 55%, about 60%, about 65%, about 70%, about 75%, about 80%, about 85%, about 90%, about 91%, about 92%, about 93%, about 94%, about 95%, about 96%, about 97%, about 98% or about 99% or more sequence identity to that of a reference sequence (e.g., a Rep helicase, A PcrA helicase, a UvrD helicase, or a homolog or ortholog thereof).

In certain embodiments, the first amino acid is present in a Rep helicase at an amino acid sequence having at least about 15%, about 20%, about 25%, about 30%, about 35%, about 40%, about 45%, about 50%, about 55%, about 60%, about 65%, about 70%, about 75%, about 80%, about 85%, about 90%, about 91%, about 92%, about 93%, about 94%, about 95%, about 96%, about 97%, about 98% or about 99% or more amino acid sequence identity (or any ranges or points within the ranges) to FHTLGLDIIKREYAALGMKANFSLF (SEQ ID NO:13). In certain embodiments, the first amino acid is present in a Rep helicase at an amino acid sequence having at least about 15%, about 20%, about 25%, about 30%, about 35%, about 40%, about 45%, about 50%, about 55%, about 60%, about 65%, about 70%, about 75%, about 80%, about 85%, about 90%, about 91%, about 92%, about 93%, about 94%, about 95%, about 96%, about 97%, about 98% or about 99% or more amino acid sequence identity (or any ranges or points within the ranges) to GLYDAHLKACNVLDFDDLI (SEQ ID NO:14).

In certain embodiments, the second amino acid is present in a Rep helicase at an amino acid sequence having at least about 15%, about 20%, about 25%, about 30%, about 35%, about 40%, about 45%, about 50%, about 55%, about 60%, about 65%, about 70%, about 75%, about 80%, about 85%, about 90%, about 91%, about 92%, about 93%, about 94%, about 95%, about 96%, about 97%, about 98% or about 99% amino acid sequence identity (or any ranges or points within the ranges) to AYLRVLTNPDDDSAF (SEQ ID NO:15). In certain embodiments, the second amino acid is present in a Rep helicase at an amino acid sequence having at least about 15%, about 20%, about 25%, about 30%, about 35%, about 40% about 45%, about 50% about 55%, about 60%, about 65%, about 70%, about 75%, about 80%, about 85%, about 90%, about 91%, about 92% about 93% about 94%, about 95%, about 96%, about 97%, about 98% or about 99% amino acid sequence identity (or any ranges or points within the ranges) to GEWAMTRNKSMFTA (SEQ ID NO:16).

Suitable amino acid positions for modifying to engineer helicase-$_X$ polypeptides (and homologs and orthologs thereof) according to the invention can be identified by one of ordinary skill in the art using this disclosure and well-known local sequence alignment tools.

Techniques for determining nucleic acid and amino acid "sequence identity" are known in the art. Typically, such techniques include determining the nucleotide sequence of genomic DNA, mRNA or cDNA made from an mRNA for a gene and/or determining the amino acid sequence that it encodes, and comparing one or both of these sequences to a second nucleotide or amino acid sequence, as appropriate. In general, "identity" refers to an exact nucleotide-to-nucleotide or amino acid-to-amino acid correspondence of two polynucleotides or polypeptide sequences, respectively. Two or more sequences (polynucleotide or amino acid) can be compared by determining their "percent identity." The percent identity of two sequences, whether nucleic acid or amino acid sequences, is the number of exact matches between two aligned sequences divided by the length of the shorter sequences and multiplied by 100.

An approximate alignment for nucleic acid sequences is provided by the local homology algorithm of Smith and Waterman, Advances in Applied Mathematics 2:482-489 (1981). This algorithm can be applied to amino acid sequences by using the scoring matrix developed by Dayhoff, Atlas of Protein Sequences and Structure, M. O. Dayhoff ed., 5 suppl. 3:353-358, National Biomedical Research Foundation, Washington, D.C., USA, and normalized by Gribskov (1986) Nucl. Acids Res. 14:6745. An exemplary implementation of this algorithm to determine percent identity of a sequence is provided by the Genetics Computer Group (Madison, Wis.) in the "BestFit" utility application. The default parameters for this method are described in the Wisconsin Sequence Analysis Package Program Manual, Version 8 (1995) (available from Genetics Computer Group, Madison, Wis.).

One method of establishing percent identity in the context of the present invention is to use the MPSRCH package of programs copyrighted by the University of Edinburgh, developed by John F. Collins and Shane S. Sturrok, and distributed by IntelliGenetics, Inc. (Mountain View, Calif.). From this suite of packages, the Smith-Waterman algorithm can be employed where default parameters are used for the scoring table (for example, gap open penalty of 12, gap extension penalty of one, and a gap of six). From the data generated the "match" value reflects "sequence identity." Other suitable programs for calculating the percent identity or similarity between sequences are generally known in the art, for example, another alignment program is BLAST, used with default parameters. For example, BLASTN and BLASTP can be used using the following default parameters: genetic code=standard; filter=none; strand=both; cutoff=60; expect=10; Matrix=BLOSUM62; Descriptions=50 sequences; sort by .dbd.HIGH SCORE; Databases=non-redundant, GenBank+EMBL+DDBJ+PDB+GenBank CDS translations+Swiss protein+Spupdate+PIR. Details of these programs can be found at the NCBI/NLM web site.

In certain embodiments of the invention, a helicase is provided that is conformationally-constrained. The term "conformationally-constrained" refers to a conformation having a least one degree of freedom (that is, motion or range of motion) that is less than a reference conformation. In certain embodiments, a conformationally-constrained helicase has a least one degree of freedom that is less than a helicase that is not conformationally constrained.

In certain embodiments of the invention, a helicase is constrained via a covalent linkage between two or more amino acids of the helicase. A covalent linkage is a chemical linkage between two atoms or radicals formed by the sharing of a pair of electrons (i.e., a single bond), two pairs of electrons (i.e., a double bond) or three pairs of electrons (i.e., a triple bond). Covalent linkages are also known in the art as election pair interactions or electron pair bonds.

In certain embodiments, a covalent linkage is formed via a crosslink between the side chains of two (or more) amino acids of a polypeptide (e.g., between two (or more) amino acids of a modified helicase).

As used herein the term "crosslink" refers to the joining of two or more molecules by a covalent bond. Crosslinking can occur via disulfide bonds, e.g., between cysteine residues. Crosslinking can occur via the use of crosslinking reagents (or chemical crosslinkers), which are molecules that contain two or more reactive ends capable of chemically attaching to specific functional groups (primary amines, sulfhydryls, etc.) on proteins or other molecules.

The terms "intramolecular crosslinking agent" and "chemical crosslinking agent" refer to a compound that can form covalent bonds via specific functional groups (e.g., primary amines, sulfhvdryls, etc.) on proteins or other molecules. An example of an intramolecular or chemical crosslinking agent includes a compound having two bifunctional groups in its structure.

Chemical crosslinkers are known in the art, and are commercially available (e.g., from Thermo Fisher Scientific, Waltham, Mass.). In certain embodiments, a crosslinker is cleavable (e.g., by reducing one or more of the functional groups of the crosslinker). In other embodiments, a crosslinker is not cleavable.

Examples of chemical crosslinkers include, but are not limited to, those having the following functional groups: maleimide, active esters, succinimide, azide, alkyne (such as dibenzocyclooctynol (DIBO or DBCO), difluoro cycloalkynes and linear alkynes), phosphine (such as those used in traceless and non-traceless Staudinger ligations), haloacetyl (such as iodoacetamide), phosgene type reagents, sulfonyl chloride reagents, isothiocyanates, acyl halides, hydrazines, disulphides, vinyl sulfones, aziridines and photoreactive reagents (such as aryl azides, diaziridines). Reactions between amino acids and functional goups may be spontaneous, such as cysteine/maleimide, or may require external reagents, such as Cu(I) for linking azide and linear alkynes.

Linkers can comprise any molecule that stretches across the distance required. Linkers can vary in length from one carbon (phosgene-type linkers) to many Angstroms. In certain embodiments, the linker includes an alkyl having a length in the range from $C_7$ to $C_{23}$. In some embodiments, the linker includes an alkyl having a length in the range from $C_8$ to $C_{13}$.

Examples of linear molecules include but are not limited to, polyethyleneglycols (PEGs), polypeptides, polysaccharides, deoxyribonucleic acid (DNA), peptide nucleic acid (PNA), threose nucleic acid (TNA), glycerol nucleic acid (GNA), saturated and unsaturated hydrocarbons, and polyamides. These linkers may be inert or reactive, in particular they may be chemically cleavable at a defined position, or may be themselves modified with a ligand. In certain embodiments, the linker is resistant to dithiothreitol (DTT).

Examples of crosslinkers include, but are not limited to 2,5-dioxopyrrolidin-1-yl 3-(pyridin-2-yldisulfanyl)propanoate, 2,5-dioxopyrrolidin-1-yl 4-(pyridin-2-yldisulfanyl)butanoate and 2,5-dioxopyrrolidin-1-yl 8-(pyridin-2-yldisulfanyl)octananoate, di-maleimide PEG 1k, di-maleimide PEG 3.4k, di-maleimide PEG 5k, di-maleimide PEG 10k, bis (maleimido)ethane (BMOE), bis-maleimidohexane (BMH), 1,4-bis-maleimidobutane (BMB), 1,4 bis-maleimidyl-2,3-dihydroxybutane (BMDB), BM[PEO]2 (1,8-bis-maleimidodiethyleneglycol), BM[PEO]3 (1,11-bis-maleimidotriethylene glycol), tris[2-maleimidoethyl]amine (TMFA), dithiobismaleimidoethane (DTME), bis-maleimide PEG3, bis-maleimide PEGU, DBCO-maleimide, DBCO-PEG4-maleimide, DBCO-PEG4-NH2, DBCO-PEG4-NHS, DBCO-NHS, DBCO-PEG-DBCO 2.8 kDa, DBCO-PEG-DBCO 4.0 kDa, DBCO-15 atoms-DBCO, DBCO-26 atoms- DBCO, DBCO-35 atoms-DBCO, DBCO-PEG4-S-S-PEG3-biotin, DBCO-S-S-PEG3-biotin, DBCO-S-S-PEG11-biotin and (succinimidyl 3-(2-pyridyldithio)propionate (SPDP).

In certain embodiments, a covalent linkage refers to the linkage between two or more amino acids. One or more of the linked amino acids may be naturally occurring or non-naturally occurring. One or more of the linked amino acids may be chemically modified.

As used herein, a "natural amino acid" refers to the twenty genetically encoded alpha-amino acids. See, e.g., Biochemistry by L. Stryer, 3$^{rd}$ ed. 1988, Freeman and Company, New York for structures of the twenty natural amino acids.

As used herein, an "unnatural amino acid," "modified amino acid" or "chemically modified amino acid" refers to any amino acid, modified amino acid, or amino acid analogue other than the twenty genetically encoded alpha-amino acids. Unnatural amino acids have side chain groups that distinguish them from the natural amino acids, although unnatural amino acids can be naturally occurring compounds other than the twenty proteinogenic alpha-amino acids. In addition to side chain groups that distinguish them from the natural amino acids, unnatural amino acids may have an extended backbone such as beta-amino acids.

Non-limiting examples of unnatural amino acids include selenocysteine, pyrrolysine, homocysteine, an O-methyl-L-tyrosine, an L-3-(2-naphthyl)alanine, a 3-methyl-phenylalanine, an O-4-allyl-L-tyrosine, a 4-propyl-L-tyrosine, a tri-O-acetyl-GlcNAcβ-serine, an L-Dopa, a fluorinated phenylalanine, an isopropyl-L-phenylalanine, a p-azido-L-phenylalanine, a p-acyl-L-phenylalanine, a p-benzoyl-L-phenylalanine, an L-phosphoserine, a phosphonoserine, a phosphonotyrosine, a p-iodo-phenylalanine, a p-bromophenylalanine, a p-amino-L-phenylalanine, an isopropyl-L-phenylalanine, an unnatural analogue of a tyrosine amino acid; an unnatural analogue of a glutamine amino acid; an unnatural analogue of a phenylalanine amino acid; an unnatural analogue of a serine amino acid; an unnatural analogue of a threonine amino acid; an alkyl, aryl, acyl, azido, cyano, halo, hydrazine, hydrazide, hydroxyl, alkenyl, alkynl, ether, thiol, sulfonyl, seleno, ester, thioacid, borate, boronate, phospho, phosphono, phosphine, heterocyclic, enone, imine, aldehyde, hydroxylamine, keto, or amino substituted amino acid, or any combination thereof; an amino acid with a photoactivatable cross-linker; a spin-labeled amino acid; a fluorescent amino acid; an amino acid with a novel functional group; an amino acid that covalently or noncovalently interacts with another molecule; a metal binding amino acid; a metal-containing amino acid; a radioactive amino acid; a photocaged and/or photoisomerizable amino acid; a biotin or biotin-analogue containing amino acid; a glycosylated or carbohydrate modified amino acid; a keto containing amino acid; amino acids comprising polyethylene glycol or polyether; a heavy atom substituted amino acid; a chemically cleavable or photocleavable amino acid; an amino acid with an elongated side chain; an amino acid containing a toxic group; a sugar substituted amino acid, e.g., a sugar substituted serine or the like; a carbon-linked sugar-containing amino acid; a redox-active amino acid; an α-hydroxy containing acid; an amino thio acid containing amino acid; an α,α disubstituted amino acid; a β-amino acid; and a cyclic amino acid other than proline. In an embodiment of the helicases described herein, one or more amino acids of the helicase are substituted with one or more unnatural amino acids and/or one or more natural amino acids.

In certain embodiments, a helicase-$_X$ is a closed form, conformationally-constrained helicase monomer generated from a helicase polypeptide that was reacted with an intramolecular crosslinking agent. In certain embodiments, a helicase-$_Y$ is an open form, conformationally-constrained helicase monomer generated from a helicase polypeptide that was reacted with an intramolecular crosslinking agent.

Figure 1A:
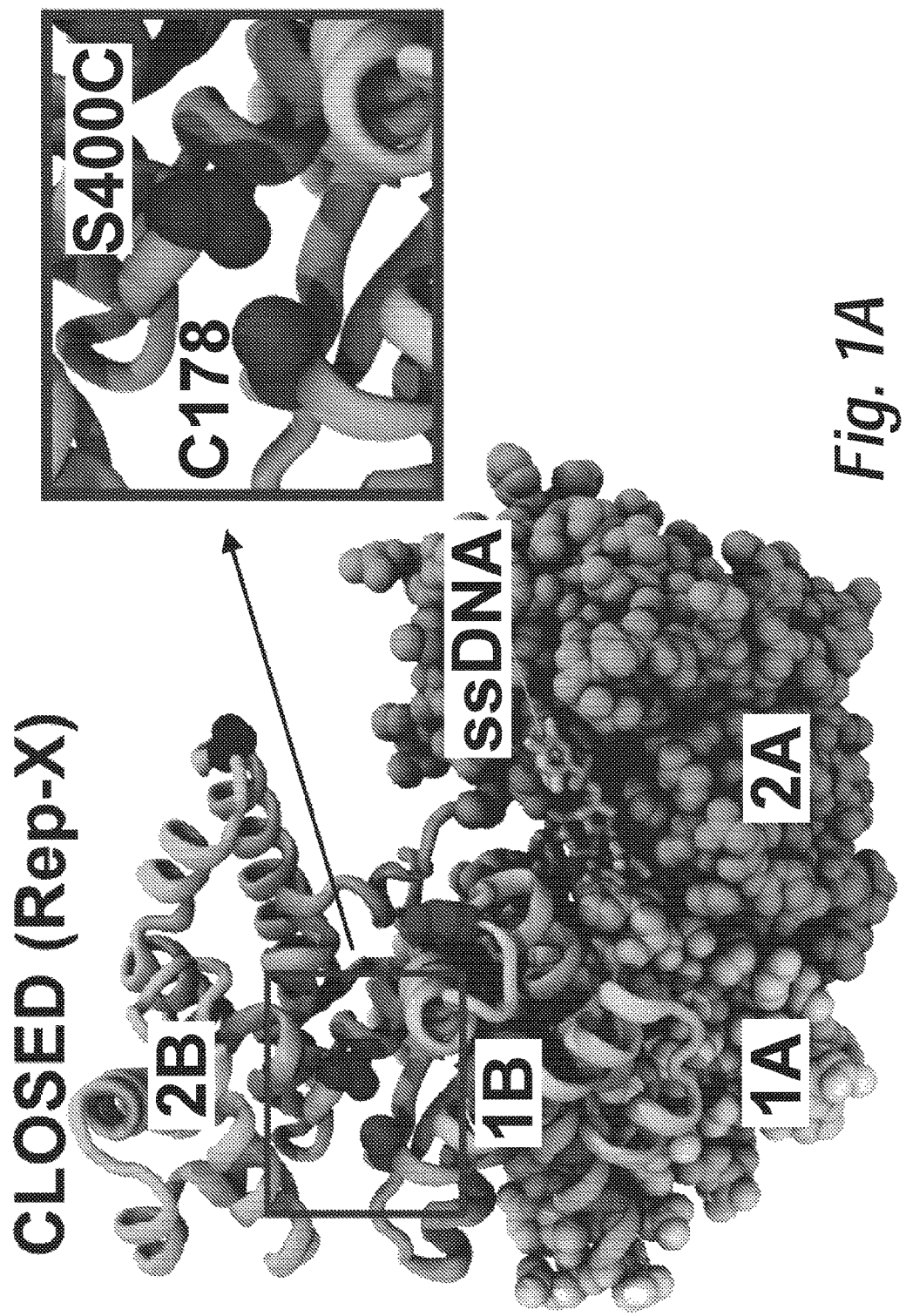
Figure 1B:
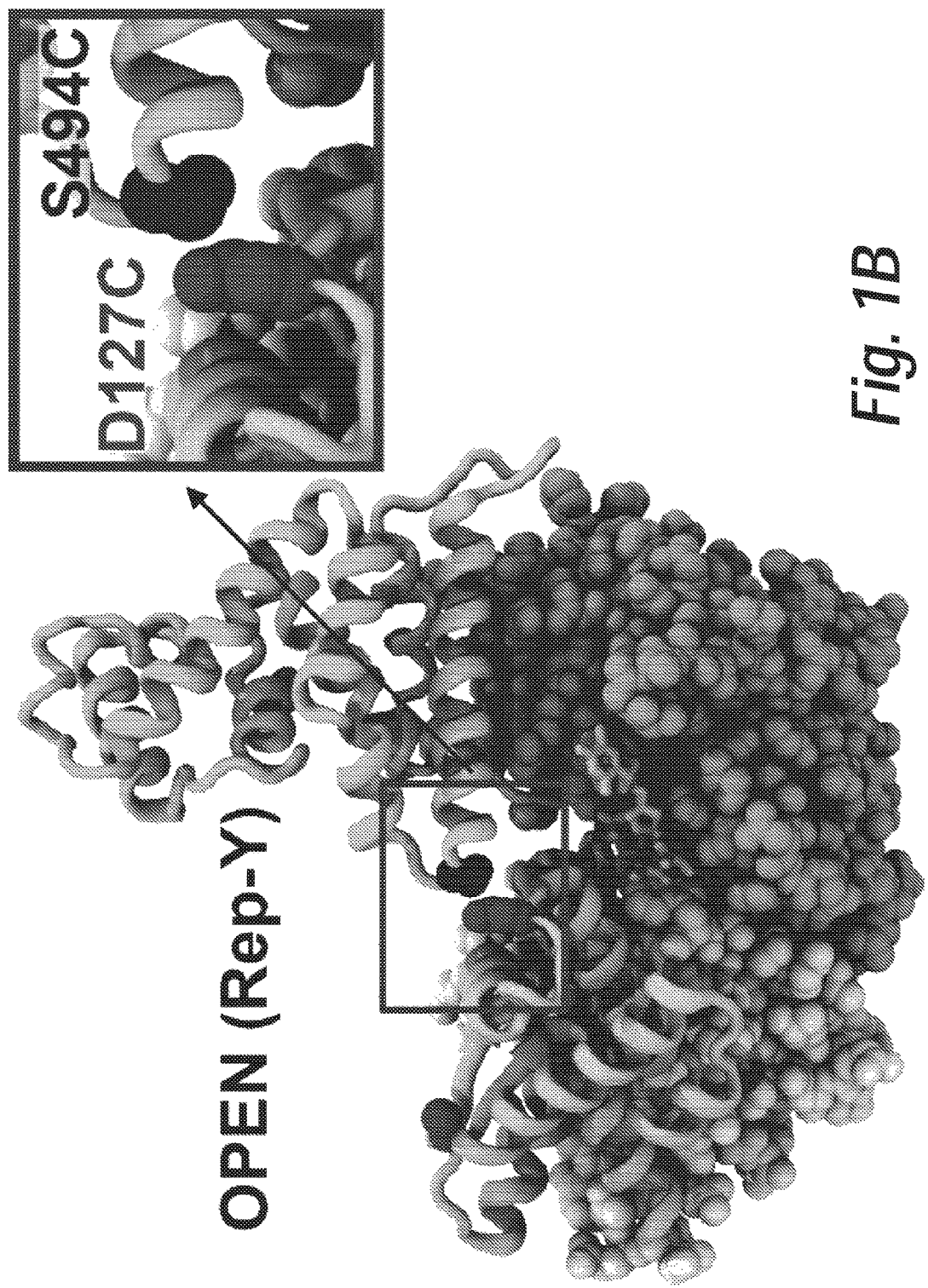

The chemical structures described herein are named according to IUPAC nomenclature rules and include art-accepted common names and abbreviations where appropriate. The IUPAC nomenclature can be derived with chemical structure drawing software programs, such as ChemDraw® (PerkinElmer, Inc.), ChemDoodle® (iChemLabs, LLC) and Marvin (ChemAxon Ltd.). The chemical structure controls in the disclosure to the extent that an IUPAC name is misnamed or otherwise conflicts with the chemical structure disclosed herein. *E. coli* Rep mutants can be engineered that are intramolecularly crosslinked to constrain the 2B subdomain in open or closed conformations. Residues for the cysteine substitution mutagenesis and the length of the bis-maleimide crosslinkers were selected such that when crosslinked, the 2B subdomain cannot rotate appreciably, effectively locking the protein in one conformation (FIG. 1A, B). The closed fix in of a helicase that is crosslinked in a constrained conformation is denoted with the suffix "-X", and the open form of a helicase that is crosslinked in a constrained conformation is denoted with the suffix "-Y." For Rep, Rep-X and Rep-Y represent the conformationally-constrained closed and open forms, respectively. Enzymatic activities of Rep-X and Rep-Y monomers were studied in single molecule and ensemble assays employing fluorescence resonance energy transfer (FRET), total internal reflection fluorescence (TIRF) microscopy, and optical tweezers force spectroscopy.

The Rep mutant sequences used to generate Rep-X and Rep-Y include those nucleotide and amino acid sequences identified in Table 1.

TABLE 1

| Amino Acid and Nucleotide Sequences for exemplary Rep-X and Rep-Y proteins | |
|---|---|
| Polypeptide/DNA/RNA (SEQ ID NO:_) | 5'→3' (nucleotide sequence) N→C (amino acid sequence) |
| Wild type Rep helicase (gene sequence) >gi\|556503834:3960677-3962698 *Escherichia coli* str. K-12 substr. MG1655, complete genome (SEQ ID NO: 31) | ATGCGTCTAAACCCCGGCCAACAACAAGCTGTCGAATTCGTT ACCGGCCCCTGCCTGGTGCTGGCGGGCGCGGGTTCCGGTAAA ACTCGTGTTATCACCAATAAAATCGCCCATCTGATCCGCGGTT GCGGTTATCAGGCGCGGCACATTGCGGCGGTGACCTTTACTA ATAAAGCAGCGCGCGAGATGAAAGAGCGTGTAGGGCAGACG CTGGGGCGCAAAGAGGCGCGTGGGCTGATGATCTCCACTTTC CATACGTTGGGGCTGGATATCATCAAACGCGAGTATGCGGCG CTTGGGATGAAAGCGAACTTCTCGTTGTTTGACGATACCGATC AGCTTGCTTTGCTTAAAGAGTTGACCGAGGGGCTGATTGAAG ATGACAAAGTTCTCCTGCAACAACTGATTTCGACCATCTCTAA |

TABLE 1 -continued

Amino Acid and Nucleotide Sequences for exemplary Rep-X and Rep-Y proteins

| Polypeptide/DNA/RNA (SEQ ID NO:_) | 5'→3' (nucleotide sequence) N→C (amino acid sequence) |
|---|---|
| | CTGGAAGAATGATCTCAAAACACCGTCCCAGGCGGCAGCAAG TGCGATTGGCGAGCGGGACCGTATTTTTGCCCATTGTTATGGG CTGTATGATGCACACCTGAAAGCCTGTAACGTTCTCGACTTCG ATGATCTGATTTTATTGCCGACGTTGCTGCTGCAACGCAATGA AGAAGTCCGCAAGCGCTGGCAGAACAAAATTCGCTATCTGCT GGTGGATGAGTATCAGGACACCAACACCAGCCAGTATGAGCT GGTGAAACTGCTGGTGGGCAGCCGCGCGCGCTTTACCGTGGT GGGTGACGATGACCAGTCGATCTACTCCTGGCGCGGTGCACG TCCGCAAAACCTGGTGCTGCTGAGTCAGGATTTTCCGGCGCTG AAGGTGATTAAGCTTGAGCAGAACTATCGCTCTTCCGGGCGT ATTCTGAAAGCGGCGAACATCCTGATCGCCAATAACCCGCAC GTCTTTGAAAAGCGTCTGTTCTCCGAACTGGGTTATGGCGCGG AGCTAAAAGTATTAAGCGCGAATAACGAAGAACATGAGGCTG AGCGCGTTACTGGCGAGCTGATCGCCCATCACTTCGTCAATAA AACGCAGTACAAAGATTACGCCATTCTTTATCGCGGTAACCAT CAGTCGCGGGTGCTTGAAAAATTCCTGATGCAAAACCGCATC CCGTACAAAATATCTGGTGGTACGTCGTTTTTCTCTCGTCCTG AAATCAAGCACTTGCTGGCTTATCTGCGCGTGCTGACTAACCC GGACGATGACAGCGCATTTCTGCGTATCGTTAACACGCCGAA GCGAGAGATTGGCCCGGCTACGCTGAAAAAGCTGGGTGAGTG GGCGATGACGCGCAATAAAAGCATGTTTACCGCCAGCTTTGA TATGGGCCTGAGTCAGACGCTTAGCGGACGTGGTTATGAAGC ATTGACCCGCTTCACTCACTGGTTGGCAGAAATCCAGCGTCTG GCGGAGCGGGAGCCGATTGCCGCGGTGCGTGATCTGATCCAT GGCATGGATTATGAATCCTGGCTGTACGAAACATCGCCCAGC CCGAAAGCCGCCGAAATGCGCATGAAGAACGTCAACCAACTG TTTAGCTGGATGACGGAGATGCTGGAAGGCAGTGAACTGGAT GAGCCGATGACGCTCACCCAGGTGGTGACGCGCTTTACTTTGC GCGACATGATGGAGCGTGGTGAGAGTGAAGAAGAGCTGGATC AGGTGCAACTGATGACTCTCCACGCGTCGAAAGGGCTGGAGT TTCCTTATGTCTACATGGTCGGTATGGAAGAAGGGTTTTTGCC GCACCAGAGCAGCATCGATGAAGATAATATCGATGAGGAGCG GCGGCTGGCCTATGTCGGCATTACCCGCGCCCAGAAGGAATT GACCTTTACGCCTGTGTAAAGAACGCCGTCAGTACGGCGAACT GGTGCGCCCGGAGCCGAGCCGCTTTTTGCTGGAGCTGCCGCA GGATGATCTGATTTGGGAACAGGAGCGCAAAGTGGTCAGCGC CGAAGAACGGATGCAGAAAGGGCAAAGCCATCTGGCGAATCT GAAAGCGATGATGGCGGCAAAACGAGGGAAATAA |
| Wild type Rep helicase (amino acid sequence) >gi\|48994965\|gb AAT48209.1\|DNA helicase and single-stranded DNA-dependent ATPase [*Escherichia coli* str. K-12 substr. MG16] (SEQ ID NO: 32) | MRLNPGQQQAVEFVTGPCLVLAGAGSGKTRVITNKIAHLIRGCG YQARHIAAVTFTNKAAREMKERVGQTLGRKEARGLMISTFHTLG LDIIKREYAALGMKANFSLFDDTDQLALLKELTEGLIEDDKVLLQ QLISTISNWKNDLKTPSQAAASAIGERDRIFAHCYGLYDAHLKAC NVLDFDDLILLPTLLLQRNEEVRKRWQNKIRYLLVDEYQDTNTS QYELVKLLVGSRARFTVVGDDDQSIYSWRGARPQNLVLLSQDFP ALKVIKLEQNYRSSGRILKAANILLANNPHVFEKRLFSELGYGAEL KVLSANNEEHEAERVTGELIAHHFVNKTQYKDYAILYRGNHQSR VFEKFLMQNRIPYKISGGTSFFSRPEIKDLLAYLRVLTNPDDDSAF LRIVNTPKREIGPATLKKLGEWAMTRNKSMFTASFDMGLSQTLS GRGYEALTRFTHWLAEIQRLAEREPIAAVRDLIHGMDYESWLYE TSPSPKAAEMRMKNVNQLFSWMTEMLEGSELDEPMTLTQVVTR FTLRDMMERGESEEELDQVQLMTLHASKGLEFPYVYMVGMEEG FLPHQSSIDEDNIDEERRLAYVGITRAQKELTFTLCKERRQYGELV RPEPSRFLLELPQDDLIWEQERKVVSAEERMQKGQSHLANLKAM MAAKRGK |
| Rep-X polypmtide[1] (SEQ ID NO: 1) | MRLNPGQQQAVEFVTGPLLVLAGAGSGKTRVITNKIAHLIRGSG YQARHIAAVTFTNKAAREMKERVGQTLGRKEARGLMISTFHTLG LDIIKREYAALGMKANFSLFDDTDQLALLKELTEGLIEDDKVLLQ QLISTISNWKNDLKTPSQAAASAIGERDRIFAHVYGLYDAHLKAC NVLDFDDLILLPTLLLQRNEEVRKRWQNKIRYLLVDEYQDTNTS QYELVKLLVGSRARFTWGDDDQSIYSWRGARPQNLVLLSQDFP ALKVIKLEQNYRSSGRILKAANILIANNPHVFEKRLFSELGYGAEL KVLSANNEEHEAERVTGELLAHHFVNKTQYKDYAILYRGNHQSR VFEKFLMQNRIPYKISGGTSFFSRPEIKDLLAYLRVLTNPDDDCAF LRIVNTPKREIGPATLKKLGEWAMTRNKSMFTASFDMGLSQTLS GRGYEALTRFTHWLAEIQRLAEREPIAAVRDLIHGMDYESWLYE TSPSPKAAEMRMKNVNQLFSWNTEMLEGSELDEPMTLTQVVTR FTLRDMMERGESEEELDQVQLMTLHASKGLEFPYVYMVGMEEG FLPHQSSIDEDNIDEERRLAYVGITRAQKELTFTLAKERRQYGELV RPEPSRFLLELPQDDLIWEQERKVVSAEERMQKGQSHLANLKAM MAAKRGK |

TABLE 1 -continued

Amino Acid and Nucleotide Sequences for exemplary Rep-X and Rep-Y proteins

| Polypeptide/DNA/RNA (SEQ ID NO:_) | 5'→3' (nucleotide sequence) N→C (amino acid sequence) |
|---|---|
| Rep-$_X$ DNA[2] (SEQ ID NO: 2) | ATGCGTCTAAACCCCGGCCAACAACAAGCTGTCGAATTCGTT<br>ACCGGCCCCTTGCTGGTGCTGGCGGGCGCGGGTTCCGGTAAA<br>ACTCGTGTTATCACCAATAAAATCGCCCATCTGATCCGCGGTA<br>GCGGGTACCAGGCGCGGCACATTGCGGCGGTGACCTTTACTA<br>ATAAAGCAGCGCGCGAGATGAAAGAGCGTGTAGGGCAGACG<br>CTGGGGCGCAAAGAGGCGCGTGGGCTGATGATCTCCACTTTC<br>CATACGTTGGGGCTGGATATCATCAAACGCGAGTATGCGGCG<br>CTTGGGATGAAAGCGAACTTCTCGTTGTTTGACGATACCGATC<br>AGCTTGCTTTGCTTAAAGAGTTGACCGAGGGGCTGATTGAAG<br>ATGACAAAGTTCTCCTGCAACAACTGATTTCGACCATCTCTAA<br>CTGGAAGAATGATCTCAAAACACCGTCCCAGGCGGCAGCAAG<br>TGCGATTGGCGAGCGGGACCGTATTTTTGCCCATGTTTATGGG<br>CTGTATGATGCACACCTGAAAGCCTGTAACGTTCTCGACTTCG<br>ATGATCTGATTTTATTGCCGACGTTGCTGCTGCAACGCAATGA<br>AGAAGTCCGCAAGCGCTGGCAGAACAAAATTCGCTATCTGCT<br>GGTGGATGAGTATCAGGACACCAACACCAGCCAGTATGAGCT<br>GGTGAAACTGCTGGTGGGCAGCCGCGCGCTTTACCGTGGT<br>GGGTGACGATGACCAGTCGATCTACTCCTGGCGCGGTGCACG<br>TCCGCAAAACCTGGTGCTGCTGAGTCAGGATTTTCCGGCGCTG<br>AAGGTGATTAAGCTTGAGCAGAACTATCGCTCTTCCGGGCGT<br>ATTCTCAAAGCGGCGAACATCCTGATCGCCAATAACCCGCAC<br>GTCTTTGAAAAGCGTCTGTTCTCCGAACTGGGTTATGGCGCGG<br>ACTCTAAAAGTATTAAGCGCGAATAACGAAGAACATGAGGCTG<br>AGCGCGTTACTGGCGAGCTGATCGCCCATCACTTCGTCAATAA<br>AACGCAGTACAAAGATTACGCCATTCTTTATCGCGGTAACCAT<br>CAGTCGCGGGTGTTTGAAAAATTCCTGATGCAAAACCGCATC<br>CCGTACAAAATATCTGGTGGTACGTCGTTTTTCTCTCGTCCTG<br>AAATCAAGGACTTGCTGGCTTATCTGCGCGTGCTGACTAACCC<br>GGACGATGACTGCGCATTTCTGCGTATCGTTAACACGCCGAA<br>GCGAGAGATTGGCCCGGCTACGCTGAAAAAGCTGGGTGAGTG<br>GGCGATGACGCGCAATAAAAGCATGTTTACCGCCAGCTTTGA<br>TATGGGCCTGAGTCAGACGCTTAGCGGACGTGGTTATGAAGC<br>ATTGACCCGCTTCACTCACTGGTTGGCAGAAATCCAGCGTCTG<br>GCGGAGCGGGAGCCGATTGCCGCGGTGCGTGATCTGATCCAT<br>GGCATGGATTATGAATCCTGGCTGTACGAAACATCGCCCAGC<br>CCGAAAGCCGCCGAAATGCGCATGAAGAACGTCAACCAACTG<br>TTTAGCTGGATGACGGAGATGCTGGAAGGCAGTGAACTGGAT<br>GAGCCGATGACGCTCACCCAGGTGGTGACGCGCTTTACTTTGC<br>GCGACATGATGGAGCGTGGTGAGAGTGAAGAAGAGCTGGATC<br>AGGTGCAACTGATGACTCTCCACGCGTCGAAAGGGCTGGAGT<br>TTCCTTATGTCTACATGGTCGGTATGGAAGAAGGGTTTTTGCC<br>GCACCAGAGCAGCATCGATGAAGATAATATCGATGAGGAGCG<br>GCGGCTGGCCTATGTCGGCATTACCCGCGCCCAGAAGGAATT<br>GACCTTTACGCTGGCTAAAGAACGCCGTCAGTACGGCGAACT<br>GGTGCGCCCGGAGCCGAGCCGCTTTTTGCTGGAGCTGCCGCA<br>GGATGATCTGATTTGGGAACAGGAGCGCAAAGTGGTCAGCGC<br>CGAAGAACGGATGCAGAAAGGGCAAAGCCATCTGGCGAATCT<br>GAAAGCGATGATGGCGGCAAAACGAGGGAAATAA |
| Rep-$_X$ RNA[3] (SEQ ID NO: 3) | AUGCGUCUAAACCCCGGCCAACAACAAGCUGUCGANUUCGU<br>UACCGGCCCCUUGCUGGUGCUGGCGGGCGCGGGUUCCGGUA<br>AAACUCGUGUUAUCACCAAUAAAAUCGCCCAUCUGAUCCGC<br>GGUAGCGGGUACCAGGCGCGGCACAUUGCGGCGGUGACCUU<br>UACUAAUAAAGCAGCGCGCGAGAUGAAAGAGCGUGUAGGGC<br>AGACGCUGGGGCGCAAAGAGGCGCGUGGGCUGAUGAUCUCC<br>ACUUUCCAUACGUUGGGGCUGGAUAUCAUCAAACGCGAGUA<br>UGCGGCGCUUGGGAUGAAAGCGAACUUCUCGUUGUUUGACG<br>AUACCGAUCAGCUUGCUUUGCUUAAAGAGUUGACCGAGGGG<br>CUGAUUGAAGAUGACAAAGUUCUCCUGCAACAACUGAUUUC<br>GACCAUCUCUAACUGGAAGAAUGAUCUCAAAACACCGUCCC<br>AGGCGGCAGCAAGUGCGAUUGQCGAGCGGGACCGUAUUUUU<br>GCCCAUGUUUAUGGGCUGUAUGAUGCACACCUGAAAGCCUG<br>UAACGUUCUCGACUUCGAUGAUCUGAUUUUAUUGCCGACGU<br>UGCUGCUGCAACGCAAUGAAGAAGUCCGCAAGCGCUGGCAG<br>AACAAAAUUCGCUAUCUGCUGGUGGAUGAGUAUCAGGACAC<br>CAACACCAGCCAGUAUGAGCUGGUGAAACUGCUGGUGGGCA<br>GCCGCGCGCUUUACCGUGGUGGGUGACGAUGACCAGUCG<br>AUCUACUCCUGGCGCGGUGCACGUCCGCAAAACCUGGUGCU<br>GCUGAGUCAGGAUUUUCCGGCGCUGAAGGUGAUUAAGCUUG<br>AGCAGAACUAUCGCUCUUCCGUGCGUAUUCUGAAAGCGGCG<br>AACAUCCUGAUCGCCAAUAACCCGCACGUCUUUGAAAAGCG<br>UCUGUUCUCCGAACUGGGUUAUGGCGCGGAGCUAAAGUAU<br>UAAGCGCGAAUAACGAAGAACAUGAGGCUGAGCGCGUUACU |

TABLE 1 -continued

Amino Acid and Nucleotide Sequences for exemplary Rep-X and Rep-Y proteins

| Polypeptide/DNA/RNA (SEQ ID NO:_) | 5'→3' (nucleotide sequence) N→C (amino acid sequence) |
|---|---|
| | GGCGAGCUGAUCGCCCAUCACUUCGUCAAUAAAACGCAGUA CAAAGNUUACGCCAUUCUUUAUCGCGGUAACCAUCAGUCGC GGGUGUUUGAAAAAUUCCUGAUGCAAAACCGCAUCCCGUAC AAAAUAUCUGGUGGUACGUCGUUUUUCUCUCGUCCUGAAAU CAAGGACUUGCUGGCUUAUCUGCGCGUGCUGACUAACCCGG ACGAUGACUGCGCAUUUCUGCGUAUCGUUAACACGCCGAAG CGAGAGAUUGGCCCGGCUACGCUGAAAAAGCUGGGUGAGUG GGCCAUGACGCGCAAUAAAAGCAUGUUUACCGCCAGCUUUG AUAUGGGCCUGAGUCAGACGCUUAGCGGACGUGGUUAUGAA GCAUUGACCCGCUUCACUCACUGGUUGGCAGAAAUCCAGCG UCUGGCGGAGCGGGAGCCGAUUGCCGCGGUGCGUGAUCUGA UCCAUGGCAUGGAUUAUGAAUCCUGGCUGUACGAAACAUCG CCCAGCCCGAAAGCCGCCGAAAUGCGCAUGAAGAACGUCAA CCAACUGUUUAGCUGGAUGACGGAGAUGCUGGAAGGCAGUG AACUGGAUGAGCCGAUGACGCUCACCCAGGUGGUGACGCGC UUUACUUUGCGCGACAUGAUGGAGCGUGGUGAGAGUGAAG AAGAGCUGGAUCAGGUGCAACUGAUGACUCUCCACGCGUCG AAAGGGCUGGAGUUUCCUUAUGUCUACAUGGUCGGUAUGG AAGAAGGGUUUUUGCCGCACCAGAGCAGCAUCGAUGAAGAU AAUAUCGAUGAGGAGCGGCGGCUGGCCUAUGUCGGCAUUAC CCGCGCCCAGAAGGAAUUGACCUUUACGCUGGCUAAAGAAC GCCGUCAGUACGGCGAACUGGUGCGCCCGGAGCCGAGCCGC UUUUUGCUGGAGCUGCCGCAGGAUGAUCUGAUUUGUGAACA GGAGCGCAAAGUGGUCAGCGCCGAAGAACGGAUGCAGAAAG GGCAAAGCCAUCUGGCGAAUCUGAAAGCGAUGAUGGCGGCA AAACGAGGGAAAUAA |
| Rep-X polypeptide[4] (SEQ ID NO: 4) | SEQ ID NO: 1 and formula no 2 in Table 2 (1-[2-(2,5-dioxopyrrol-1-yl)ethyl]pyrrole-2,5-dione) |
| Rep-Y polypeptide[5] (SEQ ID NO: 5) | MRLNPGQQQAVEFVTGPLLVLAGAGSGKTRVITNKIAHLIRGSG YQARHIAAVTFTNKAAREMKERVGQTLGRKEARGLMISTFHTLG LDIIKREYAALGMKANFSLFDDTDQLALLKELTEGLIEDDKVLLQ QLISTISNWKNDLKTPSQAAASAIGERDRIFAHVYGLYDAHLKAC NVLDFDDLILLPTLLLQRNEEVRKRWQNKIRYLLNDEYQDTNTS QYELVKLLVGSRARFTVVGDDDQSIYSWRGARPQNLVLLSQDFP ALKVIKLEQNYRSSGRILKAANILIANNPHVFEKRLFSELGYGAEL KVLSANNEEHEAERVTGELIAHHFVNKTQYKDYAILYRGNHQSR VFEKFLMQNRIPYKISGGTSFFSRPEIKDLLAYLRVLTNPDDDCAF LRIVNTPKREIGPATLKKLGEWAMTRNKSMFTASFDMGLSQTLS GRGYEALTRFTHWLAEIQRLAEREPIAAVRDLIHGMDYESWLYE TSPSPKAAEMRMKNVNQLFSWMTEMLEGSELDEPMTLTQVVTR FTLRDMMERGESEEELDQVQLMTLHASKGLEFPYVYMVGMEEG FLPHQSSIDEDNIDEERRLAYVGITRAQKELTFTLAKERRQYGELV RPEPSRFLLELPDDLIWEQERKVVSAEERMQKGQSHLANLKAM MAAKRGK |
| Rep-Y DNA[6] (SEQ ID NO:6) | ATGCGTCTAAACCCCGGCCAACAACAAGCTGTCGAATTCGTT ACCGGCCCCTTGCTGGTGCTGGCGGGCGCGGGTTCCGGTAAA ACTCGTGTTATCACCAATAAAATCGCCCATCTGATCCGCGGTA GCGGGTACCAGGCGCGGCACATTGCGGCGGTGACCTTTACTA ATAAAGCAGCGCGCGAGATGAAAGAGCGTGTAGGGCAGACG CTGGGGCGCAAAGAGGCGCGTGGGCTGATGATCTCCACTTTC CATACGTTGGGGCTGGATATCATCAAACGCGAGTATGCGGCG CTTGGGATGAAAGCGAACTTCTCGTTGTTTGACGATACCGATC AGCTTGCTTTGCTTAAAGAGTTGACCGAGGGGCTGATTGAAG ATGACAAAGTTCTCCTGCAACAACTGATTTCGACCATCTCTAA CTGGAAGAATGATCTCAAAACACCGTCCCAGGCGGCAGCAAG TGCGATTGGCGAGCGGGACCGTATTTTTGCCCATGTTTATGGG CTGTATGATGCACACCTGAAAGCCTGTAACGTTCTCGACTTCG ATGATCTGATTTTATTGCCGACGTTGCTGCTGCAACGCAATGA AGAAGTCCGCAAGCGCTGGCAGAACAAAATTCGCTATCTGCT GGTGGATGAGTATCAGGACACCAACACCAGCCAGTATGAGCT GGTGAAACTGCTGGTGGGCAGCCGCGCGCGCTTTACCGTGGT GGGTGACGATGACCAGTCGATCTACTCCTGGCGCGGTGCACG TCCGCAAAACCTGGTGCTGCTGAGTCAGGATTTTCCGGCGCTG AAGGTGATTAAGCTTGAGCAGAACTATCGCTCTTCCGGGCGT ATTCTGAAAGCGGCGAACATCCTGATCGCCAATAACCCGCAC GTCTTTGAAAAGCGTCTGTTCTCCGAACTGGGTTATGGCGCGG AGCTAAAAGTATTAAGCGCGAATAACGAAGAACATGAGGCTG AGCGCGTTACTGGCGAGCTGATCGCCCATCACTTCGTCAATAA AACGCAGTACAAAGATTACGCCATTCTTTATCGCGGTAACCAT CAGTCGCGGGTGTTTGAAAAATTCCTGATGCAAAACCGCATC |

TABLE 1 -continued

Amino Acid and Nucleotide Sequences for exemplary Rep-X and Rep-Y proteins

| Polypeptide/DNA/RNA (SEQ ID NO:_) | 5'→3' (nucleotide sequence) N→C (amino acid sequence) |
|---|---|
| | CCGTACAAAATATCTGGTGGTACGTCGTTTTTCTCTCGTCCTG AAATCAAGGACTTGCTGGCTTATCTGCGCGTGCTGACTAACCC GGACGATGACTGCGCATTTCTGCGTATCGTTAACACGCCGAA GCGAGAGATTGGCCCGGCTACGCTGAAAAAGCTGGGTGAGTG GGCGATGACGCGCAATAAAAGCATGTTTACCGCCAGCTTTGA TATGGGCCTGAGTCAGACGCTTAGCGGACGTGGTTATGAAGC ATTGACCCGCTTCACTCACTGGTTGGCAGAAATCCAGCGTCTG GCGGAGCGGGAGCCGATTGCCGCGGTGCGTGATCTGATCCAT GGCATGGATTATGAATCCTGGCTGTACGAAACATCGCCCAGC CCGAAAGCCGCCGAAATGCGCATGAAGAACGTCAACCAACTG TTTAGCTGGATGACGGAGATGCTGGAAGGCAGTGAACTGGAT GAGCCGATGACGCTCACCCAGGTGGTGACGCGCTTTACTTTGC GCGACATGATGGAGCGTGGTGAGAGTGAAGAAGAGCTGGATC AGGTGCAACTGATGACTCTCCACGCGTCGAAAGGGCTGGAGT TTCCTTATGTCTACATGGTCGGTATGGAAGAAGGGTTTTTGCC GCACCAGAGCAGCATCGATGAAGATAATATCGATGAGGAGCG GCGGCTGGCCTATGTCGGCATTACCCGCGCCCAGAAGGAATT GACCTTTACGCTGGCTAAAGAACGCCGTCAGTACGGCGAACT GGTGCGCCCGGAGCCGAGCCGCTTTTTGCTGGAGCTGCCGCA GGATGATCTGATTTGGGAACAGGAGCGCAAAGTGGTCAGCGC CGAAGAACGGATGCAGAAAGGGCAAAGCCATCTGGCGAATCT GAAAGCGATGATGGCGGCAAAACGAGGGAAATAA |
| Rep-Y RNA[7] (SEQ ID NO: 7) | AUGCGUCUAAACCCCGGCCAACAACAAGCUGUCGAAUUCGU UACCGGCCCCUUGCUGGUGCUGGCGGGCGCGGGGUUCCGGUA AAACUCGUGUUAUCACCAAUAAAAUCGCCCAUCUGAUCCGC GGUAGCGGGUACCAGGCGCGGCACAUUGCGGCGGUGACCUU UACUAAUAAAGCAGCGCGCGAGAUGAAAGAGCGUGUAGGGC AGACGCUGGGGCGCAAAGAGGCGCGUGGGCUGAUGAUCUCC ACUUUCCAUACGUUGGGGCUGGAUAUCAUCAAACGCGAGUA UGCGGCGCUUGGGAUGAAAGCGAACUUCUCGUUGUUUGACG AUACCGAUCAGCUUGCUUUGCUUAAAGAGUUGACCGAGGGG CUGAUUGAAGAUGACAAAGUUCUCCUGCAACAACUGAUUUC GACCAUCUCUAACUGGAAGAAUGAUCUCAAAACACCGUCCC AGGCGGCAGCAAGUGCGAUUGGCGAGCGGGACCGUAUUUUU GCCCAUGUUUAUGGGCUGUAUGAUGCACACCUGAAAGCCUG UAACGUUCUCGACUUCGAUGAUCUGNUUUUAUUGCCGACGU UGCUGCUGCAACGCAAUGAAGAAGUCCGCAAGCGCUGGCAG AACAAAAUUCGCUAUCUGCUGGUGGAUGAGUAUCAGGACAC CAACACCAGCCAGUAUGAGCUGGUGAAACUGCUGGUGGGCA GCCGCGCGCGCUUUACCGUGGUGGGUGACGAUGACCAGUCG AUCUACUCCUGGCGCGGUGCACGUCCGCAAAACCUGGUGCU GCUGAGUCAGGAUUUUCCGGCGCUGAAGGUGAUUAAGCUUG AGCAGAACUAUCGCUCUUCCGGGCGUAUUCUGAAAGCGGCG AACAUCCUGAUCGCCAAUAACCCGCACGUCUUUGAAAAGCG UCUGUUCUCCGAACUGGGUUAUGGCGCGGAGCUAAAAGUAU UAAGCGCGAAUAACGAAGAACAUGAGGCUGAGCGCGUUACU GGCGAGCUGAUCGCCCAUCACUUCGUCAAUAAAAACGCAGUA CAAAGAUUACGCCAUUCUUUAUCGCGGUAACCAUCAGUCGC GGGUGUUUGAAAAAUUCCUGAUGCAAAACCGCAUCCCGUAC AAAAUAUCUGGUGGUACGUCGUUUUUCUCUCGUCCUGAAAU CAAGGACUUGCUGGCUUAUCUGCGCGUGCUGACUAACCCGG ACGAUGACUGCGCAUUUCUGCGUAUCGUUAACACGCCGAAG CGAGAGAUUGGCCCGGCUACGCUGAAAAAGCUGGGUGAGUG GGCGAUGACGCGCAAUAAAAGCAUGUUUACCGCCAGCUUUG AUAUGGGCCUGAGUCAGACGCUUAGCGGACGUGGUUAUGAA GCAUUGACCCGCUUCACUCACUGGUUGGCAGAAAUCCAGCG UCUGGCGCAGCGGCAGCCGAUUGCCGCGGUGCGUGAUCUGA UCCAUGGCAUGGAUUAUGAAUCCUGGCUGUACGAAACAUCG CCCAGCCCGAAAGCCGCCGAAAUGCGCAUGAAGAACGUCAA CCAACUGUUUAGCUGGAUGACGGAGAUGCUGGAAGGCAGUG AACUGGAUGAGCCGAUGACGCUCACCCAGGUGGUGACGCGC UUUACUUUGCGCGACAUGAUGGAGCGUGGUGAGAGUGAAG AAGAGCUGGAUCAGGUGCAACUGAUGACUCUCCACGCGUCG AAAGGGCUGGAGUUUCCUUAUGUCUACAUGGUCGGUAUGG AAGAAGGGUUUUUGCCGCACCAGAGCAGCAUCGAUGAAGAU AAUAUCCAUGGGAGCGGCGGCUGGCCUAUGUCGGCAUUAC CCGCGCCCAGAAGGAAUUGACCUUUACGCUGGCUAAAGAAC GCCGUCAGUACGGCGAACUGGUGCGCCCGGAGCCGAGCCGC UUUUUGCUGGAGCUGCCGCAGGAUGAUCUGAUUUGGGAACA GGAGCGCAAAGUGGUCAGCGCCGAAGAACGGAUGCAGAAAG GGCAAAGCCAUCUGGCGAAUCUGAAAGCGAUGAUGGCGGCA AAACGAGGGAAAUAA |

TABLE 1 -continued

Amino Acid and Nucleotide Sequences for exemplary Rep-X and Rep-Y proteins

| Polypeptide/DNA/RNA (SEQ ID NO:_) | 5'→3' (nucleotide sequence) N→C (amino acid sequence) |
|---|---|
| Rep-Y polypeptide[8] (SEQ ID NO: 8) | SEQ ID NO: 5 and formula no 2 in Table 2 (1-[2-(2,5-dioxopyrrol-1-yl)ethyl]pyrrole-2,5-dione). |

[1]This Rep mutant encodes mutations removing natural cysteine residues found in the wild-type Rep and include further amino acid mutations to facilitate intramolecular crosslinking to an intramolecular crosslinking agent to generate the Rep-x polypeptide.
[2]The DNA sequence corresponds to the open reading frame that encodes the polypeptide of SEQ ID NO: 1.
[3]The RNA sequence corresponds to the open reading frame that encodes the polypeptide of SEQ ID NO: 1.
[4]The Rep-X polypeptide closed foim monomer following reaction of Repx polypeptide (SEQ ID NO: 1) with an intramolecular crosslinking agent.
[5]This Rep mutant encodes mutations that remove natural cysteine residues found in the wild-type Rep and include further amino acid mutations to facilitate intramolecular crosslinking to an intramolecular crosslinking agent to generate the Rep-y polypeptide.
[6]The DNA sequence corresponds to the open reading frame that encodes the polypeptide of SEQ ID NO: 5.
[7]The RNA sequence corresponds to the open reading frame that encodes the polypeptide of SEQ ID NO: 5.
[8]The Rep-Y polypeptide open forui monomer following reaction of Repy polypeptide (SEQ ID NO: 5) with an intramolecular crosslinking agent:

The intramolecular crosslinking agents suitable for generating versions of Rep-$_X$ and Rep-$_Y$ include those identified in Table 2.

TABLE 2

Exemplary intramolecular crosslinking agents for generating Rep-$_X$ and Rep-$_Y$

| Formula No. | Compound Structure (IUPAC Name) |
|---|---|
| 1 | 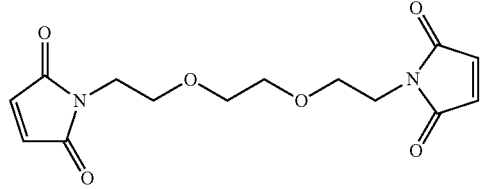<br>1-[2-[2-[2-(2,5-dioxopyrrol-1-yl)ethoxy]ethoxy]ethyl]pyrrole-2,5-dione |
| 2 | 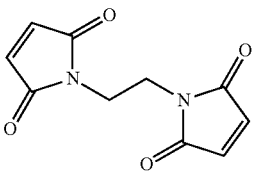 [SMILES: O=C1C=CC(=O)N1CCN1C(=O)C=CC1=O]<br>1-[2-(2,5-dioxopyrrol-1-yl)ethyl]pyrrole-2,5-dione |
| 3 | 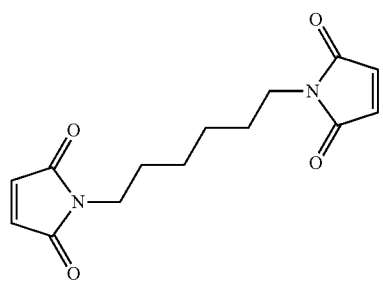<br>1-[6-(2,5-dioxopyrrol-1-yl)hexyl]pyrrole-2,5-dione |

TABLE 2-continued

Exemplary intramolecular crosslinking agents for generating Rep-$_X$ and Rep-$_Y$

| Formula No. | Compound Structure (IUPAC Name) |
|---|---|
| 4 | 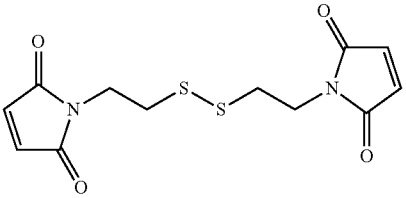<br>1-[2-[2-(2,5-dioxopyrrol-1-yl)ethyldisulfanyl]ethyl]pyrrole-2,5-dione |
| 5 | 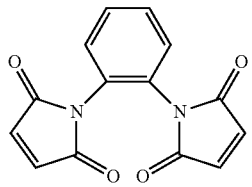<br>1-[2-(2,5-dioxopyrrol-1-yl)phenyl]pyrrole-2,5-dione |
| 6 | 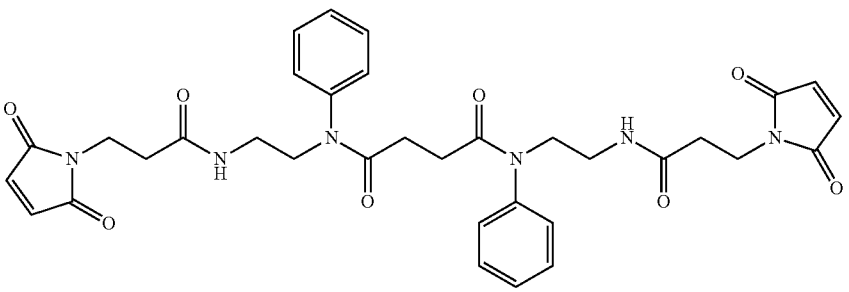<br>N,N'-bis[2-[3-(2,5-dioxopyrrol-1-yl)propanoylamino]ethyl-N,N'-diphenylbutanediamide |

These intramolecular crosslinking agents yield intramolecular crosslinked monomer structures when reacted with Rep-$_X$ and Rep-$_Y$ polypeptides. The linkers can have a length in the range from about 6 Å to about 25 Å. These types of linkers have an alkyl length in the range corresponding from about $C_7$ to about $C_{20}$, wherein highly preferred linkers have a length in the range from about $C_{10}$ to about $C_{12}$. Methods and conditions for generating intramolecular crosslink formation in proteins are well known in the art for these types of intramolecular crosslinking agents, and such methods and conditions are applicable to the helicases of this disclosure.

Figure 1C:
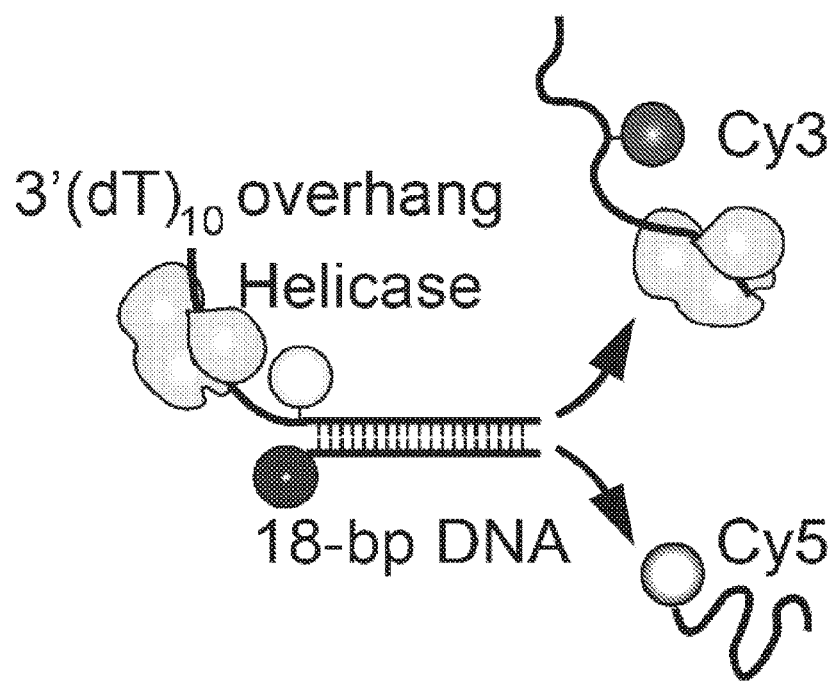
Figure 1D:
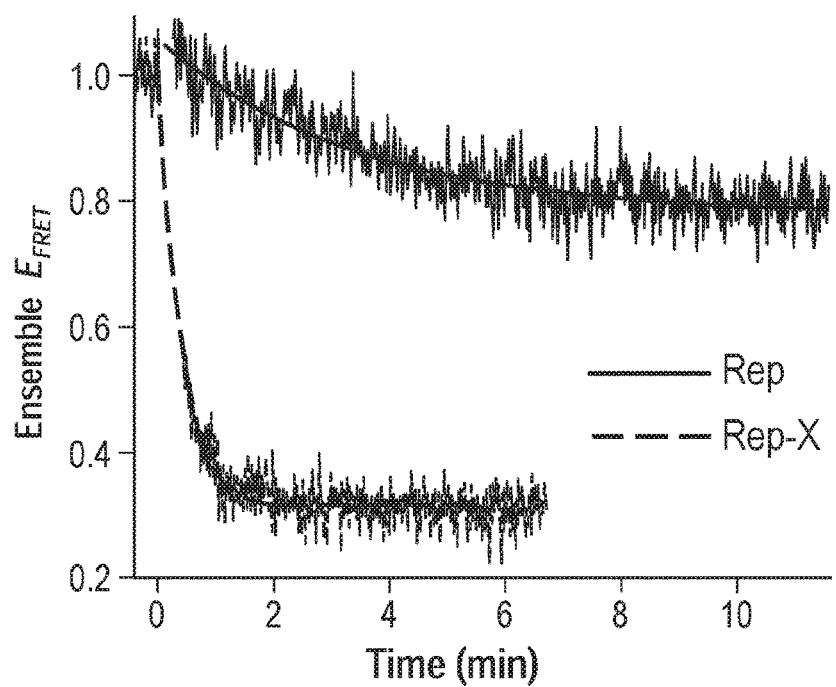

Rep-$_X$ would be inefficient in DNA unwinding even at high concentrations that make the wild type Rep active if the closed for in is inactive for unwinding. In multiple turnover ensemble unwinding reactions using FRET-labeled DNA (see, for example, FIG. 1C), however, Rep-X unwound an 18-bp substrate with a 3'-(dT)$_{10}$ overhang (SEQ ID NO: 33) at a much faster rate and higher reaction amplitude than the wild type Rep (FIG. 1D). In contrast, Rep-Y unwinding rates were similar to that of Rep (FIG. 1E), indicating that the dramatic unwinding enhancement is specifically achieved in the closed conformation. Because the large enhancement in unwinding activity observed in bulk solution can result from the activation of a monomer or from enhanced oligomerization, single molecule FRET (smFRET) experiments were performed to test if a single Rep-X can unwind DNA.

Figure 2A:
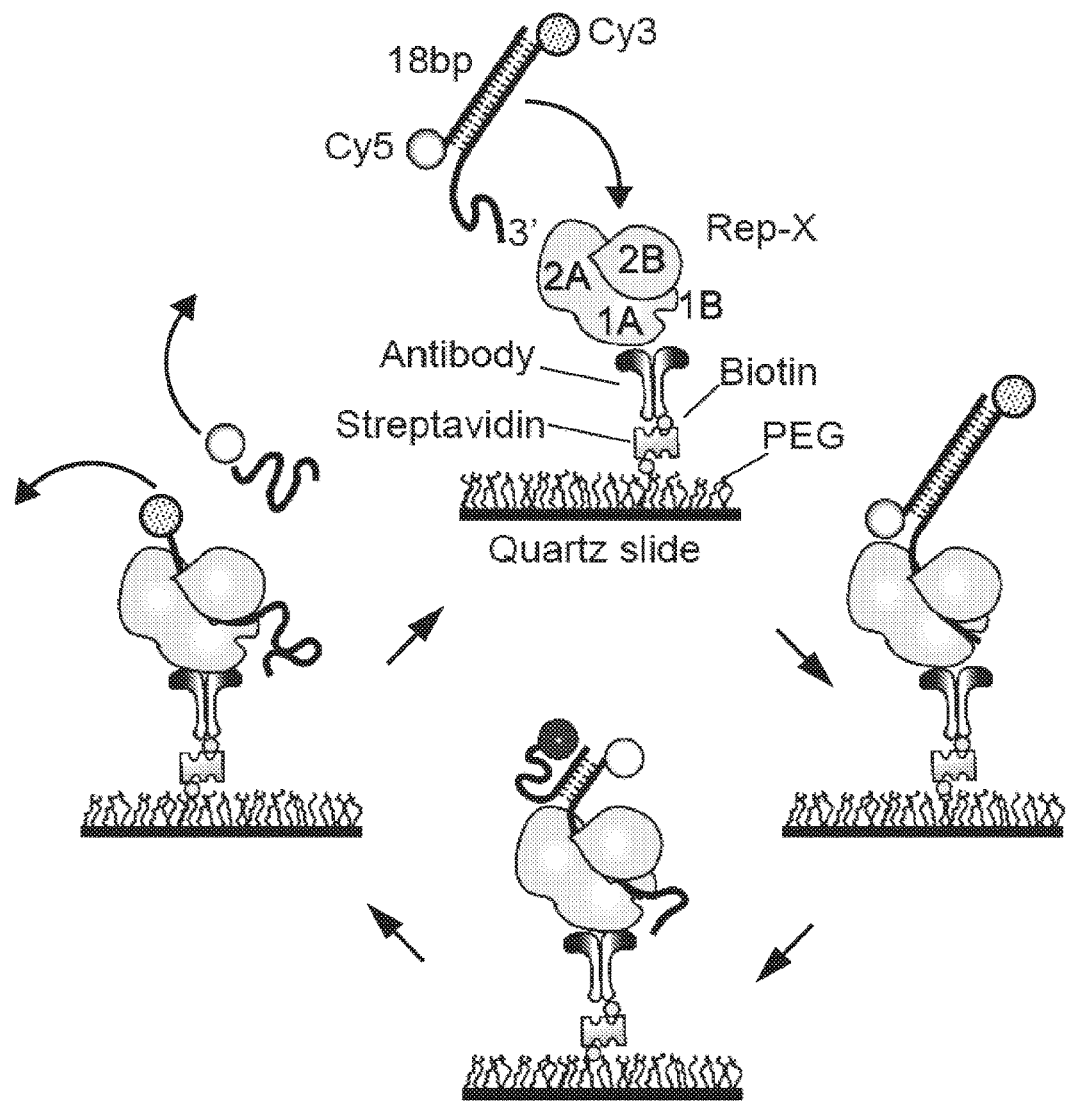
FIG. 2A depicts a schematic of unwinding stages of dual labeled DNA by a Rep-X monomer. Color lightness of the donor (green) and acceptor (red) on the DNA represents the change in the emission intensities as the unwinding progresses.
Figure 2B:
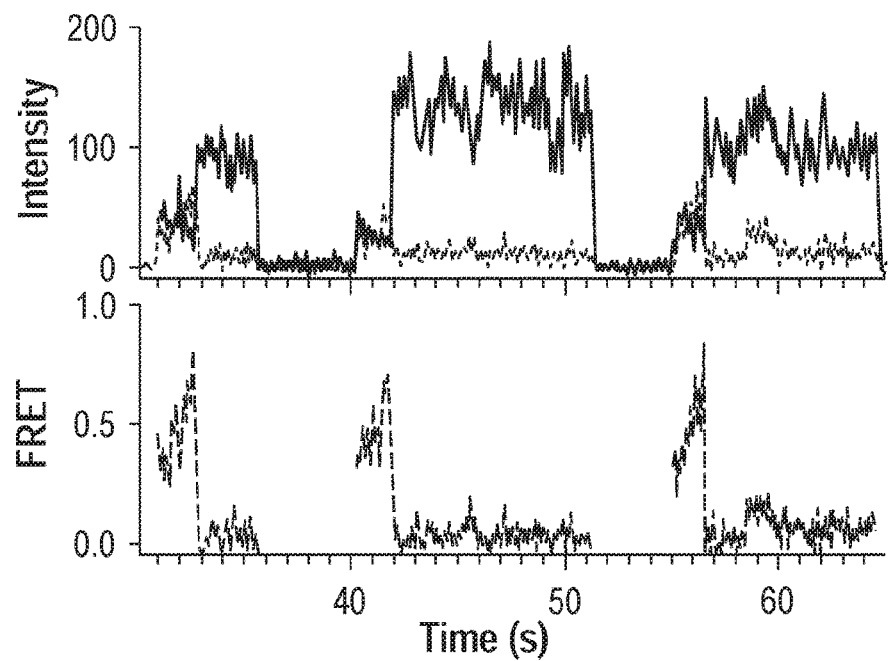
FIG. 2B depicts representative single molecule time traces show the DNA binding, unwinding and dissociation for the acceptor strand for Rep-X, wherein the donor fluorescence signal is in green, acceptor in red and $E_{FRET}$ in blue.
Figure 2C:
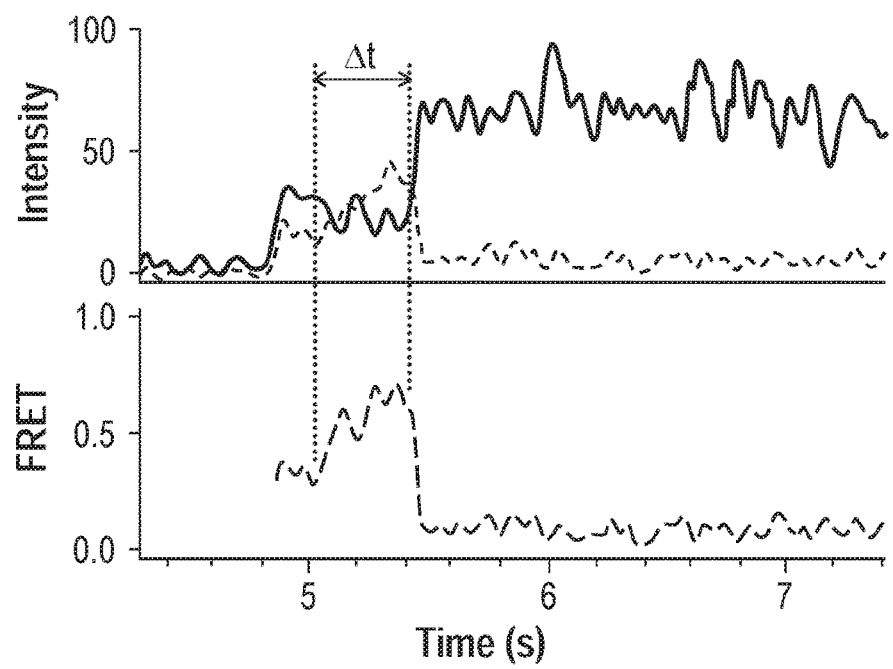
FIG. 2C depicts representative single molecule time traces showing the DNA binding, unwinding and dissociation for the donor strand for Rep-X, wherein the donor fluorescence signal is in green, acceptor in red and $E_{FRET}$ in blue. Unwinding period is denoted by Δt.
Figure 2D:
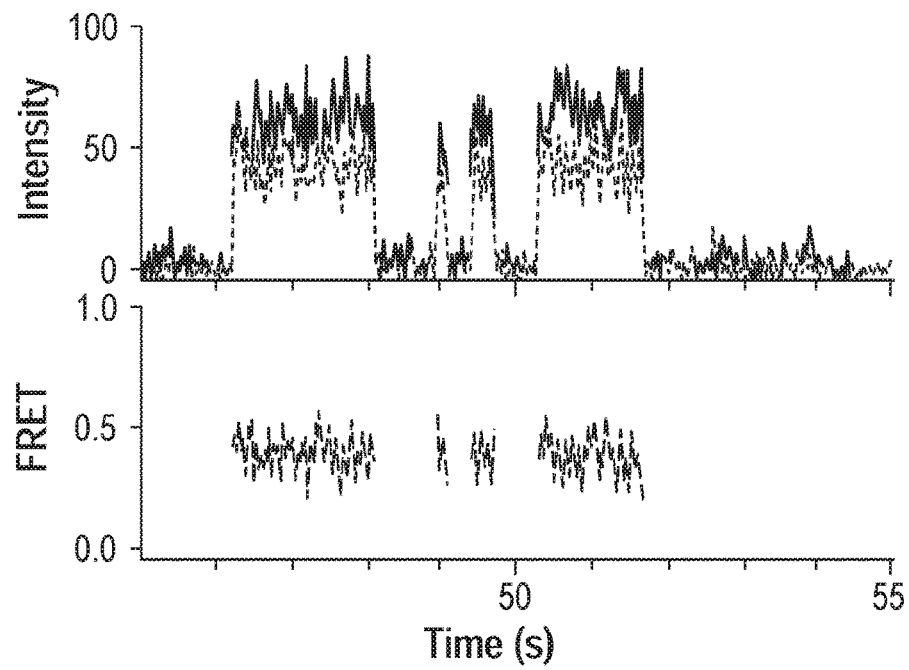
FIG. 2D depicts representative single molecule time traces showing the DNA binding and dissociation behavior for the donor strand for Rep, wherein the donor fluorescence signal is in green, acceptor in red and $E_{FRET}$ in blue.
Figure 2E:
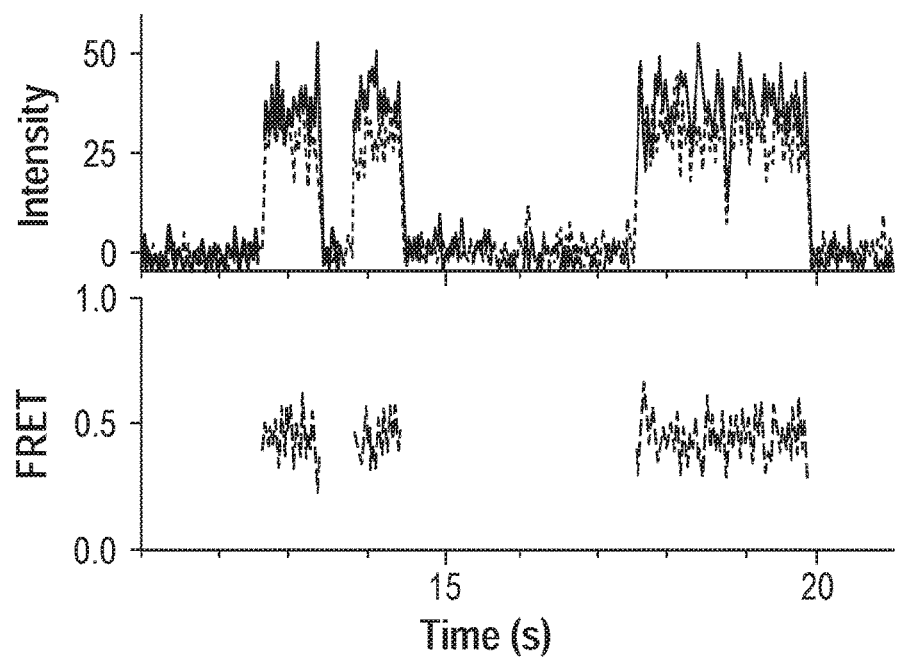
FIG. 2E depicts representative single molecule time traces showing the DNA binding and dissociation behavior for the donor su and for Rep-Y, wherein the donor fluorescence signal is in green, acceptor in red and $E_{FRET}$ in blue.
Figure 2F:
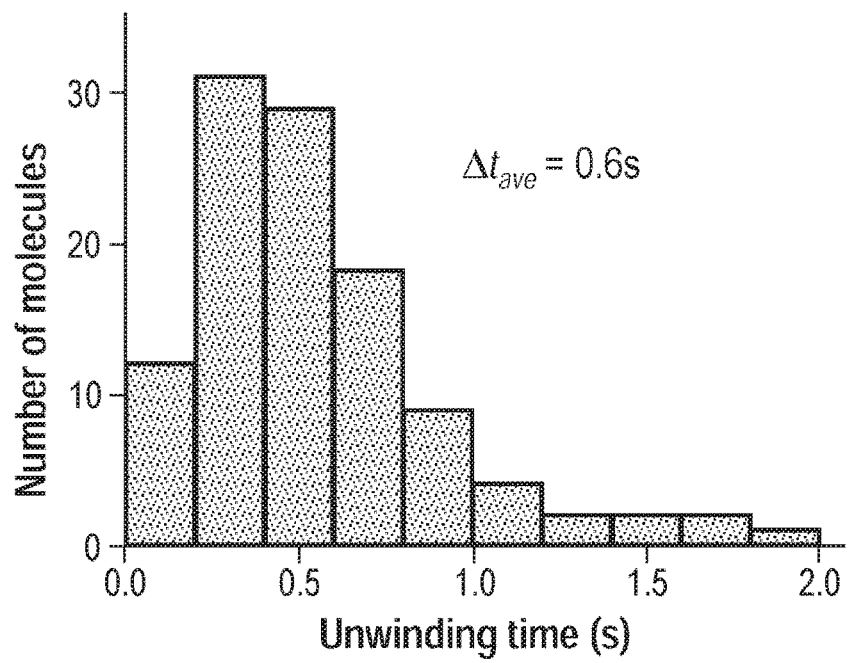
FIG. 2F depicts a representative distribution of Rep-X unwinding period Δt.
Figure 2G:
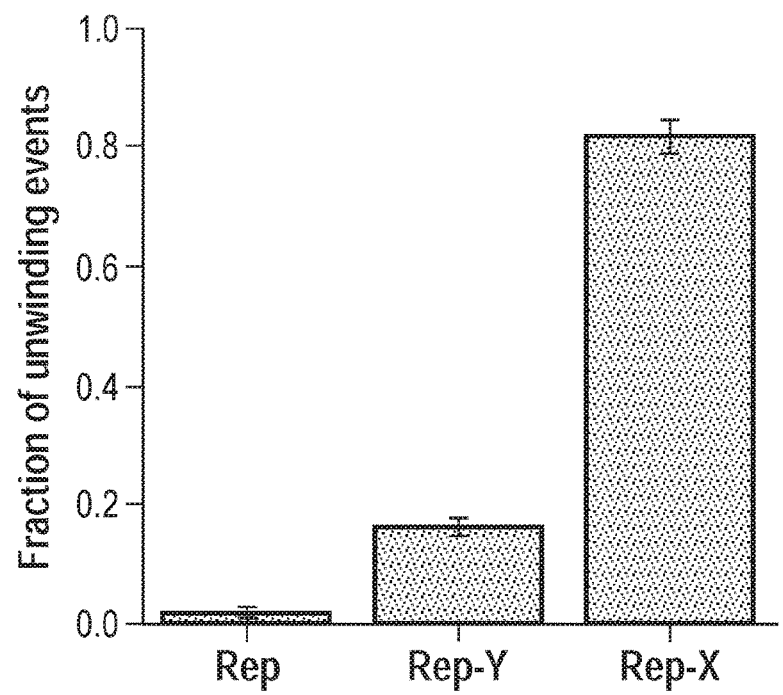
FIG. 2G depicts fractions of DNA binding events that led to unwinding (i.e. exhibited an $E_{FRET}$ increase phase) in smFRET experiments for Rep, Rep-Y and Rep-X. Error bars represent 95% confidence bounds.

Rep and Rep-X monomers were immobilized to a polymer-passivated quartz surface using antibodies against the N-terminal hexa-histidine-tag (SEQ ID NO: 36) on the protein (FIG. 2A) to ensure that the observed activity belonged to monomers (T. Ha et al., Initiation and re-initiation of DNA unwinding by the Escherichia coli Rep helicase. Nature 419, 638-641 (2002)). For the unwinding substrate, we used a 18-bp duplex DNA with a 3'-(dT)$_{20}$ overhang (SEQ ID NO: 37) labeled with a donor (Cy3) and an acceptor (Cy5) at two opposite ends of the DNA duplex, allowing us to identify unwinding reactions as increases in FRET efficiency ($E_{FRET}$) (FIG. 2A) (G. Lee, M. A. Bratkowski, F. Ding A. Ke, T. Ha, Elastic Coupling Between RNA Degradation and Unwinding by an Exoribonuclease. Science (New York, N.Y. 336, 1726-1729 (2012)). When the DNA and ATP were added to the reaction chamber, we could observe the capture of a single DNA molecule by a single protein as the sudden appearance of fluorescence signal (FIG. 2B-E). Subsequent DNA unwinding generated ssDNA strands that coil up due to high flexibility and $E_{FRET}$ increased (M. C. Murphy, I. Rasnik, W. Cheng, T. M. Lohman, T. Ha, Probing single-stranded DNA conformational flexibility using fluorescence spectroscopy. Biophysical journal 86, 2530-2537 (2004)). Once the duplex was completely unwound, the acceptor-labeled strand was released, which was marked by sudden disappearance of the acceptor signal and recovery of the donor signal. The donor-labeled strand then dissociated, resulting in complete loss of fluorescence. The mean duration of unwinding measured from the $E_{FRET}$ increase to acceptor strand release was ~0.6 s, giving a lower limit on the unwinding speed of 30 bp/s for the 18-bp substrate (FIG. 2F). About 82% of the DNA molecules (661 out of 809) that initially bound to Rep-X monomers were unwound (FIG. 2G). In contrast, only 2% of the DNA molecules (13 out of 847) that bound to Rep (i.e. without crosslinking) showed unwinding, and the unwinding yield for Rep-Y was 16% (357 out of 2212) (FIG. 2G), showing that constraining Rep into the closed form selectively activates the unwinding activity of a monomer. The nonzero amplitude of unwinding for Rep and Rep-Y may be due to conformational constraints caused by surface tethering in a small fraction of molecules.

In vitro studies have shown that the unwinding processivity of Rep and related helicases is limited even in their oligomeric forms, ranging from 30-50 bp (A. Niedziela-Majka, M. A. Chesnik, E. J. Tomko, T. M. Lohman, *Bacillus stearothermophilus* PcrA monomer is a single-stranded DNA translocase but not a processive helicase in vitro. *The Journal of biological chemistry* 282, 27076-27085 (2007); Ha et al (2008) supra; J. A. Ali, T. M. Lohman, Kinetic measurement of the step size of DNA unwinding by *Escherichia coli* UvrD helicase. *Science* (New York, N.Y. 275, 377-380 (1997)). In order to investigate the processivity of Rep-X, we employed a dual optical tweezers assay (FIG. 3A; J. R. Moffitt et al., Intersubunit coordination in a homomeric ring ATPase. *Nature* 457, 446-450 (2009)) that can monitor unwinding amplitudes and speeds over thousands of base pairs of DNA. The two traps held two streptavidin functionalized sub-micron sized polystyrene beads. The first was coated with 6-kbp dsDNA attached via a biotin on the blunt end and containing a 3' poly-dT ssDNA overhang on the other end ($(dT)_{10}$ (SEQ ID NO: 33), $(dT)_{15}$ (SEQ ID NO: 34), and $(dT)_{75}$ (SEQ ID NO: 35) see Example 7)). The other bead was coated with Rep-X molecules via biotinylated antibody against the hexa-histidine-tag (SEQ ID NO: 36). A laminar flow cell with two parallel streams of buffer was created for controlling the initiation of the unwinding reaction (inset of FIG. 3B; L. R. Brewer, P. R. Bianco, Laminar flow cells for single-molecule studies of DNA-protein interactions. *Nature methods* 5, 517-525 (2008)). When the two beads were brought in proximity in the first laminar stream (Buffer C with 100 μM ATP and 100 μM ATP-γS), a single Rep-X binding to the 3' overhang of the DNA formed a tether between the two beads without initiating unwinding. When the tethered beads were moved to the second laminar stream (Buffer C and 1 mM ATP), the DNA tether between the beads progressively shortened as the Rep-X monomer unwound and pulled the DNA. Unless otherwise stated, SSB was added to the second laminar stream in order to prevent any subsequent interaction of unwound ssDNA with other Rep-X on the bead surface. The optical tweezers experiments that were performed without SSB yielded the same Rep-X behavior (Example 7). By operating the trap under force feedback control, the tension was maintained on the DNA at 10-22 pN, as indicated. Additional controls and considerations ascertained that the observed activity stemmed from a single Rep-X regardless of the 3'-tail length and inclusion/omission of SSB (Example 7). Remarkably, 95% (38 out of 40) of the Rep-X-DNA complexes tethered through a 3'-tail unwound the entire 6-kbp DNA in a processive manner (FIG. 3B, D) and the average pause-free speed was 136 bp/s (FIG. 3C). In comparison, only 3% (2 out of 61 at 4 pN tension, none at higher forces) of wild type Rep and 7% (5 out of 70) of Rep-Y complexes displayed such processive unwinding events (FIG. 3D). Rep-X may have even greater processivity than 6-kbp, currently only limited by the length of the DNA used. The processive activity of a crosslinked Rep-X monomer shows the innate potential of these helicases that can be harnessed via conformational control.

The amount of force Rep-$_X$ can generate during unwinding was evaluated by performing measurements without the force feedback. Fixing trap positions led to a rapid build-up of force on the Rep-$_X$ in the opposite direction of unwinding until the measurement was terminated due to the breakage of connection between the two beads (FIG. 3E). The highest loads achieved in this experiment were not enough to stall the helicase permanently. More detailed analysis showed that the pause free unwinding rate of Rep-$_X$ was not impeded by increasing loads up to the limits of the linear regime of our trap (FIG. 3F), approximately 60 pN. These results suggest that the engineered Rep-X is the strongest helicase known to date (T. T. Perkins, H. W. Li, R. V. Dalal, J. Gelles, S. M. Block, Forward and reverse motion of single RecBCD molecules on DNA. *Biophysical journal* 86, 1640-1648 (2004); J. G. Yodh, M. Schlierf, T. Ha, Insight into helicase mechanism and function revealed through single-molecule approaches. *Quarterly reviews of biophysics* 43, 185-217 (2010))

In order to test if generation of a super active helicase can be reproduced for other helicases, thereby providing additional evidence of the conformational control mechanism, a PcrA-X helicase was engineered from *Bacillus stearothermophilus* PcrA. The Rep mutant sequences used to generate PcrA-$_X$ include those nucleotide and amino acid sequences identified in Table 3.

TABLE 3

| Amino Acid and Nucleotide Sequences for exemplary PcrA-$_X$ proteins | |
|---|---|
| Polypeptide/DNA/RNA (SEQ ID NO:_) | 5'→3' (nucleotide sequence) N→C (amino acid sequence) |
| Wild type PcrA helicase (gene sequence) >gi\|696477066:c17795-15621 Geobacillus stearothermophilus ATCC 7953 GBScontig0000036_2, whole genome shotgun sequence (SEQ ID NO: 38) | ATGAACTTTTTATCGGAACAGCTGCTCGCCCATTTAAACAAAG AGCAACAAGAAGCCGTCAGGACGACGGAAGGCCCGCTGCTCA TTATGGCGGGGGCGGGAAGCGGGAAAACGCGGGTGTTGACGC ACCGCATCGCCTATTTGATGGCGGAAAAGCATGTGGCGCCGT GGAACATTTTGGCCATTACGTTTACGAACAAGGCGGCGCGCG AAATGCGGGPACGTGTGCAGTCGCTCTTAGGTGGGGCGGCGG AAGACGTCTGGATTTCGACGTTCCACTCGATGTGCGTCCGCAT TTTGCGCCGCGACATTGACCGCATCGGCATCAACCGCAATTTT TCCATCCTTGATCCGACGGACCAGCTTTCAGTCATGAAAACGA TTTTAAAAGAAAAAAACATAGACCCGAAAAAATTTGAGCCGC GGACGATTTTAGGCACGATCAGCGCGGCGAAAAACGAGCTGT |

TABLE 3 -continued

Amino Acid and Nucleotide Sequences for exemplary PcrA-X proteins

| Polypeptide/DNA/RNA (SEQ ID NO:_) | 5'→3' (nucleotide sequence) N→C (amino acid sequence) |
|---|---|
| | TGCCTCCGGAGCAATTCGCGAAGCGGGCCTCGACGTATTACG<br>AAAAAGTCGTCAGCGATGTGTATCAAGAATACCAACAGCGCC<br>TGCTTCGCAATCATTCGCTCGATTTTGACGATTTGATCATGAC<br>GACGATCCAACTGTTTGACCGCGTGCCGGATGTGCTTCACTAT<br>TACCAATATAAGTTTCAGTACATTCATATTGATGAGTACCAGG<br>ATACGAACCGCGCTCAATATACGCTGGTCAAAAAGCTGGCGG<br>AACGCTTTCAAAACATTTGCGCCGTCGGCGACGCCGACCAAT<br>CGATTTATCGGTGGCGCGGGGCGGACATCCAAAACATTTTGTC<br>GTTCGAGCGCGACTATCCGAACGCAAAAGTCATTTTGCTTGAA<br>CAAAACTACCGCTCGACGAAGCGCATTTTGCAAGCGGCGAAC<br>GAAGTCATCGAGCATAACGTCAACCGGAAGCCGAAACGGCTT<br>TGGACGGAAAACCCGGAAGGAAAGCCGATTCTTTATTATGAG<br>GCGATGAACGAAGCGGACGAAGCGCAGTTTGTCGCTGGACGC<br>ATCCGCGAGGCGGTGGAGCGCGGCGAACGCCGCTACCGTGAT<br>TTTGCTGTCTTGTACCGGACGAACGCCCAGTCGCGTGTCATGG<br>AGGAAATGTTGCTGAAAGCGAACATTCCGTATCAAATTGTCG<br>GCGGCTTAAAGTTCTATGACCGGAAAGAAATTAAAGACATTC<br>TCGCCTATTTGCGCGTCATTGCCAATCCGGACGATGATTTAAG<br>CTTGCTTCGCATCATTAACGTGCCAAAACGCGGCATTGGCGCC<br>TCGACGATCGACAAACTCGTCCGCTATGCAGCCGATCATGAG<br>CTGTCCTTGTTTGAGGCGCTCGGCGAGCTAGAGATGATCGGGC<br>TTGGCGCCAAAGCGGCCGGGGCGCTCGCCGCGTCCGCAGCC<br>AGCTCGAGCAATGGACACAGCTGCAAGAATACGTCTCCGTCA<br>CCGAACTCGTCGAAGAAGTGCTCGACAAATCGGGCTACCGCG<br>AGATGCTCAAGGCGGAGCGGACGATTGAAGCACAAAGCCGG<br>CTCGAGAACTTGGATGAGTTTTTGTCGGTGACGAAGCATTTTG<br>AAAATGTGAGCGACGATAAATCGCTCATCGCCTTTTTAACCGA<br>CTTGGCGCTCATTTCCGATTTGGACGAGCTGAACGGGACGGA<br>ACAGGCCGCTGAAGGAGATGCCCGTCATGTTGATGACGTTGCA<br>TGCCGCCAAAGGGCTCGAGTTTCCGGTCGTCTTTTTGATCGGC<br>ATGGAAGAAGGCATTTTCCCGCACAACCGCTCTCTCGAGGAT<br>GACGATGAGATGGAAGAAGAACGGCGGCTGGCGTACGTCGG<br>CATCACCCGCGCGGAGGAAGAACTTGTGCTGACGAGCGCGCA<br>AATGCGGACGTTGTTTGGCAACATCCAAATGAACCCGCCGTC<br>GCGCTTTTTGAATGAAATTCCGGCGCATTTGCTTGAGACAGCC<br>TCGCGCCGCCAAGCGGGCGCCTCCCGCCCGGCCGTTTCGCGCC<br>CGCAGGCAAGCGGCGCCGTGGGATCGTGGAAAGTCGGCGATC<br>GGGCGAATCACCGGAAATGGGGCATCGGCACCGTCGTCAGCG<br>TCCGCGGCGGCGGCGACGACCAAGAGCTCGACATCGCCTTCC<br>CGAGCCCGATCGGCATTAACGGTTGCTTGCCAAATTTGCGCC<br>GATTGAGAAAGTGTAG |
| Wild type PcrA helicase (amino acid sequence) >gi\|696477065\|ref\| WP_033016687.1 ATP-dependent DNA helicase PcrA [Geobacillus stearothermophilus] (SEQ ID NO: 39) | MNFLSEQLLAHLNKEQQEAVRTTEGPLLIMAGAGSGKTRVLTHR<br>IAYLMAEKHVAPWNILAITFTNKAAREMRERVQSLLGGAAEDV<br>WISTHSMCVRILRRDIDRIGINRNFSILDPTDQLSVMKTILKEKNI<br>DPKKFEPRTILGTISAAKNELLPPEQFAKRASTYYEKVVSDVYQE<br>YQQRLLRNHSLDFDDLIMTTIQLFDRVPDVLHYYQYKYFQYIHIDE<br>YQDTNRAQYTLVKKLAERFQNICAVGDADQSIYRWRGADIQNIL<br>SFERDYPNAKVILLEQNYRSTKRILQAANEVIEHNVNRKPKRLWT<br>ENPEGKPILYYEAMNEADEAQFVAGRIREAVERGERRYRDFAVL<br>YRTNAQSRVMEEMLLKANIPYQIVGGLKFYDRKEIKDILAYLRVI<br>ANPDDDLSLLRIINVPKRGIGASTIDKLVRYAADHELSLFEALGEL<br>EMIGLGAKAAGALAAFRSQLEQWTQLQEYVSVTELVEEVLDKS<br>GYREMLKAERTIEAQSRLENLDEFLSVTKHFENVSDDKSLIAFLT<br>DLALISDLDELNGTEQAAEGDAVMLMTLHAAKGLEFPVVFLIGM<br>EEGIFPHNRSLEDDDEMEEERRLAYVGITRAEEELVLTSAQMRTL<br>FGNIQMNPPSRFLNEIPAHLLETASRRQAGASRPAVSRPQASGAV<br>GSWKVGDRANHRKWGIGTVVSVRGGGDDQELDIAFPSPIGIKKL<br>LAKFAPIEKV |
| PcrA-X polypeptide[1] (SEQ ID NO: 9) | MNFLSEQLLAHLNKEQQEAVRTTEGPLLIMAGAGSGKTRVLTHR<br>IAYLMAEKHVAPWNILAITFTNKAAREMRERVQSLLGGAAEDV<br>WISTFHSMAVRILRRDIDRIGINRNFSILDPTDQLSVMKTILKEKNI<br>DPKKFEPRTILGTISAAKNELLPPEQFAKRASTYYEKVVSDVYQE<br>YQQRLLRCHSLDFDDLIMTTIQLFDRVPDVLHYYQYKFQYIHIDE<br>YQDTNRAQYTLVKKLAERFQNIAAVGDADQSIYRWRGADIQNIL<br>SFERDYPNAKVILLEQNYRSTKRILQAANEVIEHNVNRKPKRLWT<br>ENPEGKPILYYEAMNEADEAQFVAGRIREAVERGERRYRDFAVL<br>YRTNAQSRVMEEMLLKANIPYQIVGGVKFYDRKEIKDILAYLRVI<br>ANPDDDCSLLRIINVPKRGIGASTIDKLVRYAADHELSLFEALGEL<br>EMIGLGAKAAGALAAFRSQLEQWTQLQEYVSVTELVEEVLDKS<br>GYREMLKAERTIEAQSRLENLDEFLSVTKHFENVSDDKSLIAFLT<br>DLALISDLDELNGTEQAAEGDAVMLMTLHAAKGLEFPVVFLIGM<br>EEGIFPHNRSLEDDDEMEEERRLAYVGITRAEEELVLTSAQMRTL<br>FGNIQMNPPSRFLNEIPAHLLETASRRQAGASRPAVSKPQASGAV |

TABLE 3 -continued

Amino Acid and Nucleotide Sequences for exemplary PcrA-χ proteins

| Polypeptide/DNA/RNA (SEQ ID NO:_) | 5'→3' (nucleotide sequence) N→C (amino acid sequence) |
|---|---|
| | GSWKVGDRANHRKWGIGTVVSVRGGGDDQELDIAFPSPIGIKRL LLAKFAPIEKV |
| PcrA-χ DNA[2] (SEQ ID NO: 10) | ATGAACTTTTTATCGGAACAGCTGCTCGCCCATTTAAACAAAG AGCAACAAGAAGCCGTCAGGACGACGGAAGGCCCGCTGcrcA TTATGGCGGGGGCGGGAAGCGGGAAAACGCGGGTGTTGACGC ACCGCATCGCCTATTTGATGGCGGAAAAGCATGTGGCGCCGT GGAACATTTTGGCCATTACGTTTACGAACAAGGCGGCGCGCG AAATGCGGGAACGTGTGCAGTCGCTCTTAGGTGGGGCGGCGG AAGACGTCTGGATTTCGACGTTCCACTCGATGGCCGTCCGCAT TTTGCGCCGCGACATTGACCGCATCGGCATCAACCGCAATTTT TCCATCCTTGATCCGACGGACCAGCTTTCAGTCATGAAAACGA TTTTAAAAGAAAAAAACATAGACCCGAAAAAATTTGAGCCGC GGACGATTTTAGGCACGACAGCGCGGCGAAAAACGAGCTGT TGCCTCCGGAGCAATTCGCGAAGCGGGCCTCGACGTATTACG AAAAAGTCGTCAGCGATGTGTATCAAGAATACCAACAGCGCC TGCTTCGCTGTCATTCGCTCGATTTTGACGATTTGATCATGACG ACGATCCAACTGTTTGACCGCGTGCCGGATGTGCTTCACTATT ACCAATATAAGTTTCAGTACATTCATATTGATGAGTACCAGGA TACGAACCGCGCTCAATATACGCTGGTCAAAAAGCTGGCGGA ACGCTTCAAAACATTGCCGCCGTCGGCGACGCCGACCAATC GATTTATCGGTGGCGCGGGGCGGACATCCAAACATTTTGTC GTTCGAGCGCGACTATCCGAACGCAAAGTCATTTTGCTTGAA CAAAACTACCGCTCGACGAAGCGCATTTTGCAAGCGGCGAAC GAAGTCATCGAGCATAACGTCAACCGGAAGCCGAAACGGCTT TGGACGGAAAACCCGGAAGGAAAGCCGATTCTTTATTATGAG GCGATGAACGAAGCGGACGAAGCGCAGTTTGTCGCTGGACGC ATCCGCGAGGCGGTGGAGCGCGGCGAACGCCGCTACCGTGAT TTTGCTGTCTTGTACCGGACGAACGCCCAGTCGCGTGTCATGG AGGAAATGTTGCTGAAAGCGAACATTCCGTATCAAATTGTCG GCGGCGTAAAGTTCTATGACCGGAAAGAAATTAAAGACATTC TCGCCTATTTGCGCGTCATTGCCAATCCGGACGATGATTGCAG CTTGCTTCGCATCATTAACGTGCCAAAACGCGGCATTGGCGCC TCGACGATCGACAAACTCGTCCGCTATGCAGCCGATCATGAG CTGTCCTTGTTTGAGGCGCTCGGCGAGCTAGAGATGATCGGGC TTGGCGCCAAAGCGGCCGGGGCGCTCGCCGCGTTCCGCAGCC AGCTCGAGCAATGGACACAGCTGCAAGAATACGTCTCCGTCA CCGAACTCGTCGAAGAAGTGCTCGACAAATCGGGCTACCGCG AGATGCTCAAGGCGGAGCGGACGATTGAAGCACAAAGCCGG CTCGAGAACTTGGATGAGTTTTTGTCGGTGACGAAGCATTTTG AAAATGTGAGCGACGATAAATCGCTCATCGCCTTTTTAACCGA CTTGGCGCTCATTTCCGATTTGGACGAGCTGAACGGGACGGA ACAGGCCGCTGAAGGAGATGCCGTCATGTTGATGACGTTGCA TGCCGCCAAAGGGCTCGAGTTTCCGGTCGTCTTTTTGATCGGC ATGGAAGAAGGCATTTTCCCGCACAACCGCTCTCTCGAGGAT GACGATGAGATGGAAGAAGAACGGCGGCTGGCGTACGTCGG CATCACCCGCGCGGAGGAAGAACTTGTGCTGACGAGCGCGCA AATGCGGACGTTGTTTGGCAACATCCAAATGAACCCGCCGTC GCGCTTTTTGAATGAAATTCCGGCGCATTTGCTTGAGACAGCC TCGCGCCGCCAAGCGGGCGCCTCCCGCCCGGCCGTTTCGCGCC CGCAGGCAAGCGGCGCCGTGGGATCGTGGAAAGTCGGCGATC GGGCGAATCACCGGAAATGGCTGCATCGGCACCGTCGTCAGCG TCCGCGGCGGCGGCGACGACCAAGAGCTCGACATCGCCTTCC CGAGCCCGATCGGUAUUAAACGGUUGCUUGCCAAAUUUGCGCC GAUUGAGAAAGUGUAG |
| PcrA-χ RNA[3] (SEQ ID NO: 11) | AUGAACUUUUUAUCGGAACAGCUGCUCGCCCAUUUAAACAA AGAGCAACAAGAAGCCGUCAGGACGACGGAAGGCCCGCUGC UCAUUAUGGCGGGGGCGGGAAGCGGGAAAACGCGGGUGUU GACGCACCGCAUCGCCUAUUUGAUGGCGAAAAGCAUGUGG CGCCGUGGAACAUUUUGGCCAUUACGUUUACGAACAAGGCG GCGCGCGAAAUGCGGGAACGUGUGCAGUCGCUCUUAGGUGG GGCGGCGGAAGACGUCUGGAUUUCGACGUUCCACUCGAUGG CCGUCCGCAUUUUGCGCCGCGACAUUGACCGCAUCGGCAUC AACCGCAAUUUUUCCAUCCUUGAUCCGACGGACCAGCUUUC AGUCAUGAAAACGAUUUUAAAAGAAAAAAACAUAGACCCG AAAAAAUUUGAGCCGCGGACGAUUUUAGGCACGACAGCGC GGCGAAAAACGAGCUGUUGCCUCCGGAGCAAUUCGCGAAGC GGGCCUCGACGUAUUACGAAAAAGUCGUCAGCGAUGUGUAU CAAGAAUACCAACAGCGCCUGCUUCGCUGUCAUUCGCUCGA UUUUGACGAUUUGAUCAUGACGACGAUCCAACUGUUUGACC GCGUGCCGGAUGUGCUUCACUAUUACCAAUNUAAGUUUCAG UACAUUCAUAUUGAUGAGUACCAGGAUACGAACCGCGCUCA AUAUACGCUGGUCAAAAAGCUGGCGGAACGCUUUCAAAACA UUGCCGCCGUCGGCGACGCCGACCAAUCGAUUUAUCGGUGG |

TABLE 3 -continued

Amino Acid and Nucleotide Sequences for exemplary PcrA-X proteins

| Polypeptide/DNA/RNA (SEQ ID NO:_) | 5'→3' (nucleotide sequence) N→C (amino acid sequence) |
|---|---|
| | CGCGGGGCGGACAUCCAAAACAUUUGUCGUUCGAGCGCGA<br>CUAUCCGAACGCAAAAGUCAUUUUGCUUGAACAAAACUACC<br>GCUCGACGAAGCGCAUUUUGCAAGCGGCGAACGAAGUCAUC<br>GAGCAUAACGUCAACCGGAAGCCGAAACGGCUUUGGACGGA<br>AAACCCGGAAGGAAAGCCGAUUCUUUAUUAUGAGGCGAUGA<br>ACGAAGCGGACGAAGCGCAGUUUGUCGCUGGACGCAUCCGC<br>GAGGCGGUGGAGCGCGGCGAACGCCGCUACCGUGAUUUUGC<br>UGUCUUGUACCGGACGAACGCCCAGUCGCGUGUCAUGGAGG<br>AAAUGUUGCUGAAAGCGAACAUUCCGUAUCAAAUUGUCGGC<br>GGCGUAAAGUUCUAUGACCGGAAAGAAAUUAAAGACAUUC<br>UCGCCUAUUUGCGCGUCAUUGCCAAUCCGGACGAUGAUUGC<br>AGCUUGCUUCGCAUCAUUAACGUGCCAAAACGCGGCAUUGG<br>CGCCUCGACGAUCGACAAACUCGUCCGCUAUGCAGCCGAUC<br>AUGAGCUGUCCUUGUUUGAGGCGCUCGGCGAGCUAGAGAUG<br>AUCGGGCUUGGCGCCAAAGCGGCCGGGGCGCUCGCCGCGUU<br>CCGCAGCCAGCUCGAGCAAUGGACACAGCUGCAAGAAUACG<br>UCUCCGUCACCGAACUCGUCGAAGAAGUGCUCGACAAAUCG<br>GGCUACCGCGAGAUGCUCAAGGCGGAGCGGACGAUUGAAGC<br>ACAAAGCCGGCUCGAGAACUUGGAUGAGUUUUUGUCGGUGA<br>CGAAGCAUUUUGAAAAUGUGAGCGACGAUAAAUCGCUCAUC<br>GCCUUUUUAACCGACUUGGCGCUCAUUUCCGAUUUGGACGA<br>GCUGAACGGGACGGAACAGGCCGCUGAAGGAGAUGCCGUCA<br>UGUUGAUGACGUUGCAUGCCGCCAAAGGGCUCGAGUUUCCG<br>GUCGUCUUUUUGAUCGGCAUGGAAGAAGGCAUUUUCCCGCA<br>CAACCGCUCUCUCGAGGAUGACGAUGAGAUGGAAGAAGAAC<br>GGCGGCUGGCGUACGUCGGCAUCACCCGCGCGGAGGAAGAA<br>CUUGUGCUGACGAGCGCGCAAAUGCGGACGUUGUUUGGCAA<br>CAUCCAAAUGAACCCGCCGUCGCGCUUUUUGAAUGAAAUUC<br>CGGCGCAUUUGCUUGAGACAGCCUCGCGCCGCCAAGCGGGC<br>GCCUCCCGCCCGGCCGUUUCGCGCCCGCAGUCAAGCGGCGCC<br>GUGGGAUCGUGGAAAGUCGGCGAUCGGGCGAAUCACCGGAA<br>AUGUGGCAUCGGCACCGUCGUCAGCGUCCGCGGCGGCGGCG<br>ACGACCAAGAGCUCGACAUCGCCUUCCCGAGCCCGAUCGGC<br>AUUAAACGGUUGCUUGCCAAAUUUGCGCCGAUUGAGAAAGU<br>GUAG |
| PerA-X polypeptide[4]<br>(SEQ ID NO: 12) | SEQ ID NO: 9 and formula no 1 in Table 2 (1-[2-[2-[2-(2,5-dioxopyrrol-1-yl)ethoxy]ethoxy]ethyl]pyrrole-2,5-dime). |

[1]This PcrA mutant encodes mutations removing natural cysteine residues found in the wild-type PcrA and include further amino acid mutations to facilitate intramolecular crosslinking to an intramolecular crosslinking agent to generate the PcrA-X polypeptide.
[2]The DNA sequence corresponds to the open reading frame that encodes the polypeptide of SEQ ID NO: 9.
[3]The RNA sequence corresponds to the open reading frame that encodes the polypeptide of SEQ ID NO: 9.
[4]The PcrA-X polypeptide closed form monomer following reaction of PcrA-X polypeptide (SEQ ID NO: 9) with an intramolecular crosslinking agent.

Exemplary intramolecular crosslinking agents suitable for generating versions of PcrA-$_X$ include those identified in Table 2. Methods and conditions for generating intramolecular crosslink formation in proteins are well known in the art for these types of intramolecular crosslinking agents, and such methods and conditions are applicable to the PcrA helicases of this disclosure.

Mutations involved replacing two highly conserved Cys residues in this helicase (FIG. 4A, B) which reduced the apparent ssDNA-dependent ATPase activity from approximately 40 ATP/s (wild type) to 5 ATP/s. Upon crosslinking in the closed form, PcrA-$_X$ retained the low ATPase activity (4.3 ATP/s), but exhibited an enhanced helicase activity in comparison to both the wild type and non-crosslinked mutant in ensemble reactions (FIG. 5A, B). smFRET experiments showed that PcrA-X monomers can unwind 39% (228 out of 578) of the 18-bp dsDNA they bind compared to only 4% (26 out of 617) for wild type PcrA (FIG. 6A-C). In the optical tweezers assay, PcrA-X monomers, like Rep-X, were capable of processively unwinding of 1-6 kbp long DNA, albeit at a much lower rate (2-15 bp/s, FIG. 6D) whereas no PcrA molecule (0 out of 51) was able to do the same (FIG. 6E). Despite the impaired activity levels of the PcrA mutant, conversion to PcrA-X made its monomers into highly processive helicases, thus indicating a general mechanism of conformational control for this class of helicases.

Strong helicase activity of Rep-X and PcrA-X raises the possibility that the cellular partners of Rep or PcrA may switch on the powerful unwinding activity intrinsic to these enzymes by constraining them in the closed conformation. One such partner of PcrA is RepD, a plasmid replication initiator protein from *Staphylococcus aureus* that recognizes and forms a covalent adduct with the oriD sequence of the plasmid, and then recruits PcrA for highly processive unwinding (A. F. Slatter, C. D. Thomas, M. R. Webb, PcrA helicase tightly couples ATP hydrolysis to unwinding double-stranded DNA, modulated by the initiator protein for plasmid replication, RepD. *Biochemistry* 48, 6326-6334 (2009); W. Zhang et al., Directional loading and stimulation of PcrA helicase by the replication initiator protein RepD. *Journal of molecular biology* 371, 336-348 (2007); C. Machon et al., RepD-mediated recruitment of PcrA helicase at the *Staphylococcus aureus* pC221 plasmid replication origin, oriD. *Nucleic acids research* 38, 1874-1888 (2010)). Based on the similar results from PcrA-X and the homologous *E. coli* counterpart Rep-X, but not Rep-Y, we hypothesized that the RepD-induced PcrA activity enhancement is in fact the result of the conformational constraint of the helicase in the PcrA-X-like closed form. To test this prediction, we prepared an oriD DNA-RepD adduct, and measured the intramolecular conformation of PcrA bound to this adduct. We used a double cysteine mutant of PcrA, PcrA-DM1, stochastically labeled with a mixture of donor and acceptor fluorophores that would be expected to generate high $E_{FRET}$ in the closed form and low $E_{FRET}$ in the open form (J. Park et al., PcrA helicase dismantles RecA filaments by reeling in DNA in uniform steps. Cell 142, 544-555 (2010); (FIG. 6F). The $E_{FRET}$ distributions of PcrA-DM1 bound to the oriD DNA-RepD adduct and the oriD DNA alone are shown in FIG. 6F. Only the PcrA-DM1 molecules with a fluorescence active Cy3-Cy5 pair were included in the analysis. The results revealed that the presence of RepD indeed biases PcrA toward the closed high $E_{FRET}$ conformation. Without the invention being limited to any particular mechanism, the regulation mechanism of this class of helicases may involve in vivo partner proteins that constrain the conformation of 2B subdomain to the closed form to activate its function.

Figure 1E:
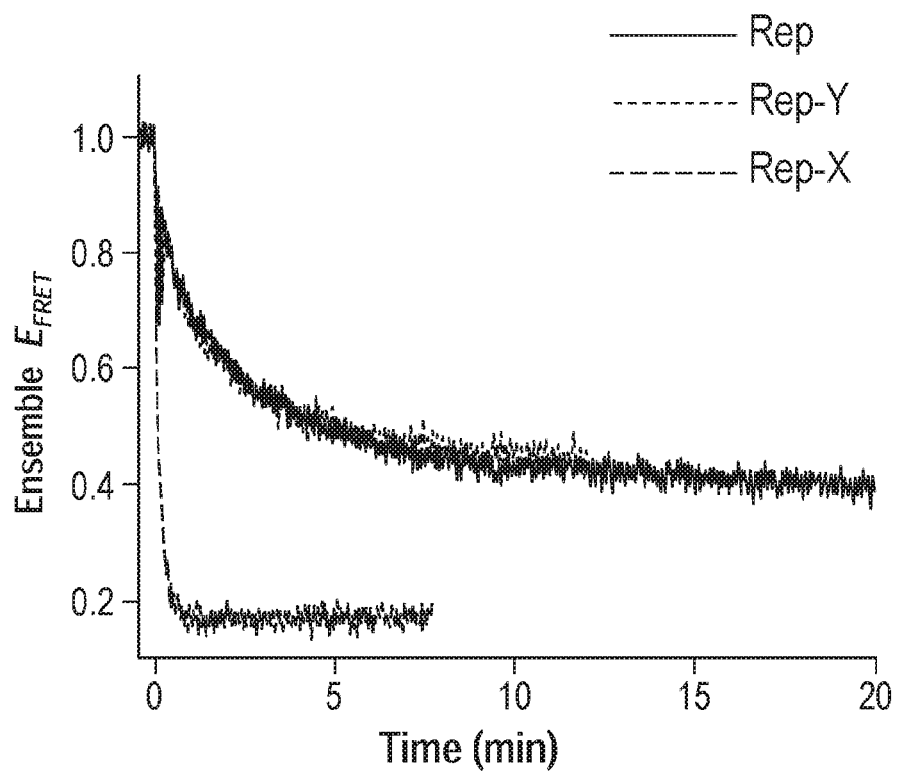

The basis for constraining Rep and PcrA into the closed form that converts an enzyme with undetectable unwinding activity to a super helicase is unknown. One possibility is that the intrinsic unwinding activity itself requires the closed form, for example via the torque-wrench mechanism proposed for UvrD (J. Y. Lee, W. Yang, UvrD helicase unwinds DNA one base pair at a time by a two-part power stroke. Cell 127, 1349-1360 (2006)). Another possibility is that the open form inhibits helicase function and crosslinking to the closed form prevents this inhibitory mechanism. Without the invention being limited to any particular theory of operation, we prefer the latter for the following reasons. First, Rep-Y crosslinked in the open form does unwind DNA as well as the wild type when the protein is at high concentrations in excess of DNA (FIG. 1E). Therefore, the closed form per se is not absolutely required for unwinding activity. Second, using ultra-high resolution optical tweezers combined with smFRET capability, we found that UvrD assumes the closed conformation when it unwinds DNA but after it unwinds about 10 bp it switches to the open conformation and rewinds the DNA likely after strand switching. Therefore, we suggest that Rep-X becomes a highly processive super-helicase because crosslinking prevents the open conformation required for strand-switching and rewinding that have been observed for UvrD (M. N. Dessinges, T. Lionnet, X. G. Xi, D. Bensimon, V. Croquette, Single-molecule assay reveals strand switching and enhanced processivity of UvrD. Proc. Natl. Acad. Sci., U.S.A. 101, 6439-6444 (2004)) and BLM (J. G. Yodh, B. C. Stevens, R. Kanagaraj, P. Janscak, T. Ha, BLM helicase measures DNA unwound before switching strands and hRPA promotes unwinding reinitiation. The EMBO journal 28, 405-416 (2009)). The enhancement of unwinding activity via the deletion of 2B domain in Rep (W. Cheng et al., The 2B domain of the Escherichia coli Rep protein is not required for DNA helicase activity. Proc. Natl. Acad. Sci., U.S.A. 99, 16006-16011 (2002)) may also be due to inhibition of strand switching (M. J. Comstock, K. D. Whitley, H. Jia, T. M. Lohman, T. Ha and Y. R. Chemla, "Direct observation of structure-function relationship in a nucleic acid processing enzyme," Science 348: 352-354 (2015).

Most conformational control of protein functions demonstrated so far first locks the naturally active protein to an artificially inhibited conformation so that additional controls imposed by researchers can be used to recover the original activity (B. Choi, G. Zocchi, Y. Wu, S. Chan, L. Jeanne Perry, Allosteric control through mechanical tension. Phy Rev Lett 95, 078102 (2005); M. Tomishige, R. D. Vale, Controlling kinesin by reversible disulfide cross-linking. Identifying the motility-producing conformational change. J Cell Biol 151, 1081-1092 (2000); D. M. Veine, K. Ohnishi, C. H. Williams, Jr., Thioredoxin reductase from Escherichia coli: evidence of restriction to a single conformation upon formation of a crosslink between engineered cysteines. Protein science: a publication of the Protein Society 7, 369-375 (1998); B. X. Huang H. Y. Kim, Interdomain conformational changes in Akt activation revealed by chemical cross-linking and tandem mass spectrometry. Mol Cell Proteomics 5, 1045-1053 (2006)). Our work is innovative and unique in that we found a conformational control that activates a naturally inhibited unwinding function, and the resulting enzyme is a super-helicase that has unprecedentedly high processivity for a single motor helicase. RecBCD, another SF-1 helicase, has similarly high processivity but contains two motors and associated nucleases. Moreover it is known to backslide at opposing forces below 10 pN whereas Rep-X can be active against forces as high as 60 pN (Perkins et al (2004) supra). This super helicase with high processivity and high tolerance against load without nuclease activities may also be useful for biotechnological applications such as single molecule nanopore sequencing (D. Branton et al., The potential and challenges of nanopore sequencing. Nature biotechnology 26, 1146-1153 (2008); A. H. Laszlo et al., Decoding long nanopore sequencing reads of natural DNA. Nature biotechnology, (2014)) and isothermal DNA amplification (M. Vincent, Y. Xu, H. Kong, Helicase-dependent isothermal DNA amplification. EMBO reports 5, 795-800 (2004).

In this regard, one type of isothermal DNA amplification for Which these super helicases have application include helicase dependent amplification. Referring to FIG. 8, the helicase dependent amplification can be characterized in three steps. In step 1, DNA helicase (104) contacts a double-stranded DNA (101) to unwind the first and second single strands (102 and 103) to provide the ability of first and second oligonucleotide primers (105 and 106) hybridize to the first and second single strands (102 and 103), respectively. In step 2: DNA-dependent DNA polymerases (107) bind to the 3'-termini of the first and second oligonucleotide primers (105 and 106) to initiate chain elongation of new strands (108 and 109). In step 3, continued DNA polymerization results in DNA amplification and formation of new double-stranded DNA (110 and 111).

Nucleic Acid Amplification

In certain exemplary embodiments, methods for amplifying nucleic acid sequences are provided. Exemplary methods for amplifying nucleic acids include the polymerase chain reaction (PCR) (see, e.g., Mullis et al. (1986) Cold Spring Harb. Symp. Quant. Biol. 51 Pt 1:263 and Cleary et al. (2004) Nature Methods 1:241; and U.S. Pat. Nos. 4,683, 195 and 4,683,202), anchor PCR, RACE PCR, ligation chain reaction (LCR) (see, e.g., Landegran et al. (1988) Science 241:1077-1080; and Nakazawa et al. (1994) Proc. Natl. Acad. Sci. U.S.A. 91:360-364), self-sustained sequence replication (Guatelli et al. (1990) Proc. Natl. Acad. Sci. U.S.A. 87:1874), transcriptional amplification system (Kwoh et al. (1989) Proc. Natl. Acad. Sci. U.S.A. 86:1173), Q-Beta Replicase (Lizardi et at (1988) BioTechnology 6:1197), recursive PCR (Jaffe et al. (2000) J. Biol. Chem. 275:2619; and Williams et al. (2002) J. Biol. Chem. 277: 7790), the amplification methods described in U.S. Pat. Nos. 6,391,544, 6,365,375, 6,294,323, 6,261,797, 6,124,090 and 5,612,199, isothermal amplification (e.g., rolling circle amplification (RCA), hyperbranched rolling circle amplification (HRCA), strand displacement amplification (SDA), helicase-dependent amplification (HDA), PWGA, or any other nucleic acid amplification method using techniques well known to those of skill in the art.

"Polymerase chain reaction," or "PCR," refers to a reaction for the in vitro amplification of specific DNA sequences by the simultaneous primer extension of complementary strands of DNA. In other words, PCR is a reaction for making multiple copies or replicates of a target nucleic acid flanked by primer binding sites, such reaction comprising one or more repetitions of the following steps: (i) denaturing the target nucleic acid, (ii) annealing primers to the primer binding sites, and (iii) extending the primers by a nucleic acid polymerase in the presence of nucleoside triphosphates. Usually, the reaction is cycled through different temperatures optimized for each step in a thermal cycler instrument. Particular temperatures, durations at each step, and rates of change between steps depend on many factors well-known to those of ordinary skill in the art, e.g., exemplified by the references: McPherson et al., editors, PCR: A Practical Approach and PCR2: A Practical Approach (IRL Press, Oxford, 1991 and 1995, respectively). For example, in a conventional PCR using Taq DNA polymerase, a double stranded target nucleic acid may be denatured at a temperature greater than 90° C., primers annealed at a temperature in the range 50-75° C., and primers extended at a temperature in the range 72-78° C.

The term "PCR" encompasses derivative forms of the reaction, including but not limited to, RT-PCR, real-time PCR, nested PCR, quantitative PCR, multiplexed PCR, assembly PCR and the like. Reaction volumes range from a few hundred nanoliters, e.g., 200 nL, to a few hundred microliters, e.g., 200 microliters. "Reverse transcription PCR," or "RT-PCR," means a PCR that is preceded by a reverse transcription reaction that converts a target RNA to a complementary single stranded DNA, which is then amplified, e.g., Tecott et al., U.S. Pat. No. 5,168,038. "Real-time PCR" means a PCR for which the amount of reaction product, i.e., amplicon, is monitored as the reaction proceeds. There are many forms of real-time PCR that differ mainly in the detection chemistries used for monitoring the reaction product, e.g., Gelfand et al., U.S. Pat. No. 5,210,015 ("Taqman"); Wittwer et al., U.S. Pat. Nos. 6,174,670 and 6,569,627 (intercalating dyes); Tyagi et al., U.S. Pat. No. 5,925,517 (molecular beacons). Detection chemistries for real-time PCR are reviewed in Mackay et al., Nucleic Acids Research, 30:1292-1305 (2002). "Nested PCR" means a two-stage PCR wherein the amplicon of a first PCR becomes the sample for a second PCR using a new set of primers, at least one of which binds to an interior location of the first amplicon. As used herein, "initial primers" in reference to a nested amplification reaction mean the primers used to generate a first amplicon, and "secondary primers" mean the one or more primers used to generate a second, or nested, amplicon. "Multiplexed PCR" means a PCR wherein multiple target sequences (or a single target sequence and one or more reference sequences) are simultaneously carried out in the same reaction mixture, e.g. Bernard et al. (1999) Anal. Biochem., 273:221-228 (two-color real-time PCR). Usually, distinct sets of primers are employed for each sequence being amplified. "Quantitative PCR" means a PCR designed to measure the abundance of one or more specific target sequences in a sample or specimen. Techniques for quantitative PCR are well-known to those of ordinary skill in the art, as exemplified in the following references: Freeman et al., Biotechniques, 26:112-126 (1999); Becker-Andre et al., Nucleic Acids Research, 17:9437-9447 (1989); Zimmerman et al., Biotechniques, 21:268-279 (1996); Diviacco et al., Gene, 122:3013-3020 (1992); Becker-Andre et al., Nucleic Acids Research, 17:9437-9446 (1989); and the like.

In one aspect of the invention, a method of performing isothermal DNA amplification is provided. The method can includes two steps. The first step includes forming a mixture. The mixture includes a double-stranded DNA template having a first strand and a second strand; a conformationally-constrained helicase; a DNA-dependent DNA polymerase; a first oligonucleotide primer complementary to a portion of the first strand; a second oligonucleotide primer complementary to a portion of the second strand; and an amplification buffer cocktail. The second step includes incubating the mixture at a temperature compatible for activating the conformationally-constrained helicase and DNA-dependent DNA polymerase. In some embodiments of this aspect, the conformationally-constrained helicase is selected from SEQ ID NOs: 4 and 12.

Nucleic Acid Sequencing

In certain exemplary embodiments, methods of determining the sequence identities of nucleic acid sequences are provided. Determination of the sequence of a nucleic acid sequence of interest can be performed using variety of sequencing methods known in the art including, but not limited to, sequencing by hybridization (SBH), sequencing by ligation (SBL), quantitative incremental fluorescent nucleotide addition sequencing (QIFNAS), stepwise ligation and cleavage, fluorescence resonance energy transfer (FRET), molecular beacons, TaqMan reporter probe digestion, pyrosequencing, fluorescent in situ sequencing (FISSEQ), FISSEQ beads (U.S. Pat. No. 7,425,431), wobble sequencing (PCT/US05/27695), multiplex sequencing (U.S. 2008/0269068; Porreca et al (2007) Nat. Methods 4:931), polymerized colony (POLONY) sequencing (U.S. Pat. Nos. 6,432,360, 6,485,944 and 6,511,803, and PCT/US05/06425), nanogrid rolling circle sequencing (ROLONY) (U.S. 2009/0018024), nanopore sequencing (using platforms such as those from Agilent, Oxford, Sequenom, Noblegen, NABsys, Genia), allele-specific oligo ligation assays (e.g., oligo ligation assay (OLA), single template molecule OLA using a ligated linear probe and a rolling circle amplification (RCA) readout, ligated padlock probes, and/or single template molecule OLA using a ligated circular padlock probe and a rolling circle amplification (RCA) readout) and the like. High-throughput sequencing methods, e.g., on cyclic array sequencing using platforms such as Roche 454, Illumina Solexa, ABI-SOLiD, ION Torrents, Complete Genomics, Pacific Bioscience, Helicos, Polonator platforms (Worldwide Web Site: Polonator.org), and the like, can also be utilized. High-throughput sequencing methods are described in U.S. 2010/0273164. A variety of light-based sequencing technologies are known in the art (Landegren et al (1998) Genome Res. 8:769-76; Kwok (2000) Pharmocogenomics 1:95-100; and Shi (2001) Clin. Chem. 47:164-172).

In certain exemplary embodiments, the DNA-dependent DNA polymerase is selected from a group consisting of *E. coli* DNA Pol I, *E. coli* DNA Pol I Large Fragment, Bst 2.0 DNA Polymerase, Bst DNA Polymerase, Bst DNA Polymerase Large Fragment Bsu DNA Polymerase I Large Fragment, T4 DNA Polymerase, T7 DNA polymerase, PyroPhage® 3173 DNA Polymerase and phi29 DNA Polymerase. In some embodiments, the conformationally-constrained helicase includes a helicase selected from superfamily 1, wherein the helicase has a first amino acid residue and a second amino acid reside, and wherein the first and second amino acid residues are in proximity. The conformationally-constrained helicase also includes a linker, wherein the linker comprises a first covalent bond with the first amino acid residue and a second covalent bond with the second amino acid residue. In some embodiments of this aspect, the conformationally-constrained helicase includes a crosslinked, closed form helicase monomer.

Expression of Helicase-$_X$ Polypeptides

The nucleic acids encoding the Rep-$_X$ and PcrA-$_X$ polypeptides can be adapted to suitable expression systems for producing the helicase$_X$ polypeptides for helicase-$_X$ production. For DNAs encoding helicase$_X$ genes, the representative genes can be operably-linked to suitable expression vectors for expressing the proteins in bacterial, fungal, insect or other suitable expression host. For RNAs encoding helicase-$_X$ polypeptides, the representative RNAs can be engineered for enabling efficient expression in vitro of the polypeptides in extract lysates produced from bacterial, fungal, insect or other suitable expression host sources. Such systems are well known in the art. Following expression, the helicase-$_X$ polypeptides can be purified by methods known in the art, including affinity-tag chromatography, SDS-PAGE, and size-exclusion chromatography, among others.

In certain exemplary embodiments, vectors such as, for example, expression vectors, containing a nucleic acid encoding one or more helicase-$_X$ polypeptides described herein are provided. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably. However, the invention is intended to include such other forms of expression vectors, such as viral vectors (e.g., replication defective retroviruses, adenoviruses and adeno-associated viruses), which serve equivalent functions.

In certain exemplary embodiments, the recombinant expression vectors comprise a nucleic acid sequence (e.g., a nucleic acid sequence encoding one or more helicase-$_X$ polypeptides described herein) in a form suitable for expression of the nucleic acid sequence in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence encoding one or more helicase-$_X$ polypeptides is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel; Gene Expression Technology: Methods in Enzymology 185, Academic Press, San Diego, Calif. (1990). Regulatory sequences include those which direct constitutive expression of a nucleotide sequence in many types of host cells and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors described herein can be introduced into host cells to thereby produce proteins or portions thereof, including fusion proteins or portions thereof, encoded by nucleic acids as described herein (e.g., one or more helicase$_X$ polypeptides).

Recombinant expression vectors of the invention can be designed for expression of one or more encoding one or more helicase-$_X$ polypeptides in prokaryotic or eukaryotic cells. For example, one or more vectors encoding one or more helicase-$_X$ polypeptides can be expressed in bacterial cells such as *E. coli*, insect cells (e.g., using baculovirus expression vectors), yeast cells or mammalian cells. Suitable host cells are discussed further in Goeddel, Gene Expression Technology: Methods in Enzymology 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith, D. B. and Johnson, K. S. (1988) Gene 67:31-40); pMAL (New England Biolabs, Beverly, Mass.); and pRIT5 (Pharmacia, Piscataway, N.J.) which fuse glutathione S-transferase (GST), maltose E binding protein, or protein A, respectively, to the target recombinant protein.

In another embodiment, the expression vector encoding one or more helicase-$_X$ polypeptides is a yeast expression vector. Examples of vectors for expression in yeast *S. cerevisiae* include pYepSec1 (Baldari, et. al., (1987) EMBO J. 6:229-234); pMFa (Kurjan and Herskowitz, (1982) Cell 30:933-943); pJRY88 (Schultz et al., (1987) Gene 54:113-123); pYES2 (Invitrogen Corporation, San Diego, Calif.); and picZ (Invitrogen Corporation).

Alternatively, one or more helicase-$_X$ polypeptides can be expressed in insect cells using baculovirus expression vectors. Baculovirus vectors available for expression of proteins in cultured insect cells (e.g., Sf9 cells) include the pAc series (Smith et al. (1983) Mol. Cell. Biol. 3:2156-2165) and the pVL series (Lucklow and Summers (1989) Virology 170: 31-39).

In certain exemplary embodiments, a nucleic acid described herein is expressed in mammalian cells using a mammalian expression vector. Examples of mammalian expression vectors include pCDM8 (Seed, B. (1987) Nature 329:840) and pMT2PC (Kaufman et al. (1987) EMBO J. 6:187-195). When used in mammalian cells, the expression vector's control functions are often provided by viral regulatory elements. For example, commonly used promoters are derived from polyoma, adenovirus 2, cytomegalovirus and simian virus 40. For other suitable expression systems for both prokaryotic and eukaryotic cells see Green M., and Sambrook; J. Molecular Cloning: A Laboratory Manual. 4th, ed., Cold Spring Harbor Laboratory, Cold Spring Harbor Laboratory Press, Cold Spring Harbor, N.Y., 2012.

In certain exemplary embodiments, host cells into which a recombinant expression vector of the invention has been introduced are provided. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, one or more helicase-$x$ polypeptides can be expressed in bacterial cells such as E. coli, viral cells such as retroviral cells, insect cells, yeast or mammalian cells (such as Chinese hamster ovary cells (CHO) or COS cells). Other suitable host cells are known to those skilled in the art.

Delivery of nucleic acids described herein (e.g., vector DNA) can be by any suitable method in the art. For example, delivery may be by injection, gene gun, by application of the nucleic acid in a gel, oil, or cream, by electroporation, using lipid-based transfection reagents, or by any other suitable transfection method.

As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAF-dextran-mediated transfection, lipofection (e.g., using commercially available reagents such as, for example, LIPOFECTIN™ (Invitrogen Corp., San Diego, Calif.), LIPOFECTAMINE™ (Invitrogen), FUGENE™ (Roche Applied Science, Basel, Switzerland), JETPEI™ (Polyplus-transfection Inc., New York, N.Y.), EFFECTENE™ (Qiagen, Valencia, Calif.), DREAM-FECT™ (OZ Biosciences, France) and the like), or electroporation (e.g., in vivo electroporation). Suitable methods for transforming or transfecting host cells can be found in Green and Sambrook, et al. (Molecular Cloning: A Laboratory Manual. 4th, ed., Cold Spring Harbor Laboratory, Cold Spring Harbor Laboratory Press, Cold Spring Harbor, N.Y., 2012), and other laboratory manuals.

Kits

In another aspect, kits are contemplated in this disclosure. For example, a kit for performing helicase dependent amplification is provided. The kit can include a conformationally-constrained helicase and an optional amplification buffer cocktail. The conformationally-constrained helicase of the kit includes one or more helicase$_x$ polypeptides having a covalent linkage (e.g., reacted with a suitable intramolecular crosslinking agent) to form closed form helicase-$x$ monomers having super helicase activity of the type described for Rep-X and PcrA-X. In particular, the conformationally-constrained helicase can be generated form reacting SEQ ID NOs:4 and 9 with a suitable intramolecular crosslinking agent. Representative conformationally-constrained helicases include those of SEQ ID NOs:4 and 12.

The kit can further include a DNA-dependent DNA polymerase. Exemplary DNA-dependent DNA polymerases for inclusion in kit include a polymerase selected from a group consisting of E. coli DNA Pol I, E. coli DNA Pol I Large Fragment, Bst 2.0 DNA Polymerase, Bst DNA Polymerase, Bst DNA Polymerase Large Fragment, Bsu DNA Polymerase I Large Fragment, T4 DNA Polymerase, T7 DNA polymerase, PyroPhage® 3173 DNA Polymerase, phi29 DNA Polymerase and the like.

EXAMPLES

Example 1. Mutagenesis and Purification of Protein

Preparation of pET expression plasmids containing cysteine-less rep (C18L, C43S, C167V, C178A, C612A) and pcrA (C96A/C247A) with N-terminal hexa-histidine-tags (SEQ ID NO: 36) were pet formed as described previously (Park et al (2005) supra, I. Rasnik, S. Myong, W. Cheng T. M. Lohman, T. Ha, DNA-binding orientation and domain conformation of the E. coli rep helicase monomer bound to a partial duplex junction: single-molecule studies of fluorescently labeled enzymes. J. Mol. Biol. 336, 395-408 (2004)). Site-directed mutations to introduce two Cys residues for crosslinking (Rep-X: A178C/S400C, Cys178 is a native cysteine in the wild type, Rep-Y: D127C/S494C, PcrA-X: N187C/L409C) were done using QuikChange Lightning kit (Life Technologies, Inc.) and mutagenic primer oligonucleotides (Integrated DNA Technologies Inc., Coralville, Iowa). Protein purifications were performed as described previously (Park et al. (2005) supra; Rasnik et al (2004) supra). Catalytic activity levels of purified proteins as well as those of the crosslinked samples were determined in a ssDNA-dependent ATPase activity assay using the Invitrogen EnzChek phosphate assay kit (Life Technologies Inc.), the oligonucleotide (dT)$_{45}$ (SEQ ID NO: 305) and 1 mM ATP in buffer D (see ensemble FRET unwinding assay).

Wild type RepD from Staphylococcus aureus was purified as described in (Slatter et al. ((2009) supra; Zhang et al., (2007) supra) with the following differences. A wt-RepD encoding pET11m-RepD plasmid was constructed for expression in B834 (pLysS). The gene sequence contained silent mutations to introduce restriction sites for AgeI, PstI, SacI, and to modify the nick site (TCTAAT to TCGAAT) to prevent premature cleavage by RepD during expression. An ammonium sulfate precipitated pellet (from 0.5 L culture) was resuspended and run through serially connected 5 ml Q-Sepharose (removed once the sample was through) and 5 ml heparin-Sepharose cartridges connected in series (GE Healthcare), and eluted on an ÄKTA purifier 10 FPLC system.

Example 2. Intra-Crosslinking of Rep and PcrA

Dual-cysteine Rep mutants were incubated overnight at 4° C. with 2- to 100-fold excess of bis-maleimide cross-linkers DTME (13 Å) and BMOE (8 Å) purchased from Thermo Fisher Scientific, Rockford, Ill. (FIG. 10). PcrA-X was crosslinked with DTME and BM(PEG)$_2$ (14.7 Å) from the same manufacturer. Excess crosslinkers were removed by Bio-Rad P-30 desalting column. Crosslinked Rep-X, Rep-Y and PcrA-X samples were stored at −20° C. or −80° C. as described (Park et al. (2005) supra; Rasnik et al. (2004) supra). Data presented in this manuscript used BMOE (8 Å), but other crosslinkers of various lengths gave similar results. DTME is a di-sulfide containing crosslinker that we reduced with β-mercaptoethanol (β-ME) or tris(2-carboxyethyl) phosphine (TCEP) to revert the crosslinked helicase to the non-crosslinked form for control purposes.

Crosslinking of the double Cys mutants with the his-maleimide linkers has the potential of producing covalently attached multimeric species, in addition to the intended internally crosslinked monomeric species. Sodium dodecyl sulfate polyacrylamide gel electrophoresis (SDS-PAGE) can distinguish these species from the non-crosslinked monomers (I. L. Urbatsch et al., Cysteines 431 and 1074 are responsible for inhibitory disulfide cross-linking between the two nucleotide-binding sites in human P-glycoprotein. *J. Biol. Chem,* 276, 26980-26987 (2001)). Here we show a representative analysis of a crosslinked Rep-Y sample. Crosslinked Rep-X and Rep-Y produced three bands on a SDS polyacrylamide gel (FIG. 7A): a bottom band at ~76 kDa that was the same as the non-crosslinked Rep, a slightly retarded dominant middle band at ~100 kDa for Rep-Y and ~90 kDa for Rep-X and a much more slowly migrated, very faint top band at ~300 kDa. FIG. 7B shows three such bands of a Rep-Y sample (lane Rep-Y) crosslinked with a cleavable di-sulfide containing crosslinker (DTME). The dominant middle band and the faint top band were the crosslinked species because they disappeared upon cleavage of the crosslinker using beta-mercaptoethanol (β-ME) (lane Rep-Y*). Relative shift between the middle bands of Rep-X and Rep-Y (FIG. 7A) was a strong indication of an internally crosslinked monomeric species, because the denatured Rep-X and Rep-Y would be likely to migrate at different rates due to the different size of peptide loops introduced by the internal crosslinker (denatured Rep-Y has a loop of 368 amino acids (aa) whereas Rep-X loop is 223 aa long). In order to ensure that the dominant middle band is not multimeric but is the intramolecularly crosslinked monomeric species, a Rep-Y sample was fractionated according to molecular size on a Superdex 200 size exclusion chromatography (SEC) column controlled by an FPLC apparatus. Elution profiles of Rep-Y and non-crosslinked Rep are shown in the FIG. 7C. Eluted fractions were analyzed on an SDS polyacrylamide gel (FIG. 7D, lanes F1-F7). The multimeric species that was eluted in the early SEC fractions (11-13 ml) displayed only the top band whereas the dominant middle band was eluted together with the non-crosslinked Rep monomer in the SEC analysis, showing that the middle band represents the intramolecularly crosslinked species and the top band is multimeric. After establishing that the intra-crosslinked protein shows up as a retarded band compared to the non-crosslinked form on the SDS polyacrylamide gels (such as the Rep-Y data presented here), we used this assay to check the efficiency of crosslinking reactions for Rep-X, Rep-Y and PcrA-X (86%, 73% and 58% respectively for the samples used in this manuscript). The Rep-Y form exhibited ATPase activity on par with non-crosslinked Rep (FIG. 7E).

Example 3. Size Exclusion Chromatography and SDS-PAGE Analysis

Crosslinked Rep and PcrA samples were separated from multimeric byproducts using Superdex 200 grade 10/300GL or HiLoad 16/600 gel filtration columns on an ÄKTA purifier 10 FPLC system. The crosslinking efficiency was monitored by SDS-PAGE analysis on 7.5-10% Tris-glycine gels (Bio-Rad). As needed for gel analysis, reduction of samples crosslinked with DTME was achieved by adding 5% (v/v) β-ME during the SDS denaturation step.

Example 4. Ensemble FRET Unwinding Assay

Multiple turnover ensemble unwinding kinetics was used to gauge the effect of the mutations and conformational modifications to the helicase activity. We used an 18-bp FRET labeled DNA substrate with a 3'-(dT)$_{10}$ overhang (SEQ ID NO: 33) (FIG. 1C), constructed by annealing complementary oligonucleotides DNA7 (Cy5-GCC TCG CTG CCG TCG CCA (SEQ ID NO: 40)) and amino-dT labeled DNA8 (TGG CGA CGG CAG CGA GGC-(T-Cy3)-T$_{10}$ (SEQ ID NO: 41)). Alternatively, another similarly labeled 50-bp DNA with 3'-(dT)$_{30}$ overhang (SEQ ID NO: 17) was also used. This construct was made by annealing oligonucleotides DNA9 (Cy5-TCA ACT AGC AGT CAT AGG AGA AGT ATT AAC ATG CCT CGC TGC CGT CGC CA (SEQ ID NO: 42)) and amino-dT labeled DNA10 (TG GCG ACG GCA GCG AGG CAT GTT AAT ACT TCT CCT ATG ACT GCT AGT TGA (T-Cy3) T$_{29}$ (SEQ ID NO: 43)). Unless otherwise stated, 5 nM ensemble FRET DNA was mixed with 50 nM helicase in buffer D (10 mM Tris-HCl [pH 8.0], 15 mM NaCl, 10 mM MgCl$_2$, 10% (v/v) glycerol, 0.1 mg/ml BSA) and 1 mM ATP was added to start the unwinding reaction in a quartz cuvette. A Cary Eclipse fluorescence spectrophotometer was used to measure the donor ($I_{555nm}$) and the acceptor signals ($I_{667nm}$) under 545-nm excitation (5-nm slit, 2-10 Hz acquisition rate and 600-900V photomultiplier voltage). Unwinding of the substrate was monitored by the decrease in ensemble $E_{FRET}$ value, defined as $E_{FRET-ensemble} = I_{667nm}/(I_{555nm}-I_0+I_{667nm})$ where $I_0$ was the baseline donor signal of unpaired Cy3 prior to addition of ATP.

Example 5. smFRET Unwinding and RepD-PcrA Interaction Assays

All smFRET experiments were conducted on a custom-built prism type TIRF microscopy stage with an Andor EMCCD camera as described in R. Roy, S. Hohng, T. Ha, A practical guide to single-molecule FRET. *Nat Methods* 5, 507-516 (2008) and C. Joo, T. Ha, in *Cold Spring Harb Protoc.* (2012), vol. 2012. Reaction chambers were formed by quartz slides and glass coverslips passivated with polyethyleneglycol (PEG) and 1% biotinylated PEG (mPEG-SC and bio-PEG-SC, Laysan Bio, Arab, Ala.), followed by 5 min incubation with Neutravidin (Thermo Scientific, Newington, N.H.) for immobilization of biotinylated molecules on the chamber surface as described below.

For the smFRET unwinding experiments, the reaction chamber was first incubated with biotinylated anti penta-histidine tag (SEQ ID NO: 44) antibody (Qiagen, Valencia, Calif.), followed by 10-30 min incubation of His$_6$-tagged (SEQ ID NO: 36) helicase sample (0.5-1 nM). The unwinding of the DNA was initiated by flowing 1 nM smFRET DNA and 1 mM ATP in the reaction buffer A (10 mM Tris-HCl [pH 8.0], 10 mM MgCl$_2$, 15 mM NaCl, 10% (v/v) glycerol, 1% (v/v) gloxy and 0.2% (w/v) glucose, an oxygen scavenging system (Y. Harada, K. Sakurada, T. Aoki, D. D. Thomas, T. Yanagida, Mechanochemical coupling in actomyosin energy transduction studied by in vitro movement assay. *J. Mol. Biol.* 216, 49-68 (1990).) and 3-4 mM Trolox (T. Yanagida, M. Nakase, K. Nishiyama, F. Oosawa, Direct observation of motion of single F-actin filaments in the presence of myosin. *Nature* 307, 58-60 (1984); I. Rasnik, S. A. McKinney, T. Ha, Nonblinking and long-lasting single-molecule fluorescence imaging. *Nat Methods* 3, 891-893 (2006)). The smFRET DNA substrate was constructed by annealing the oligonucleotides DNA3 (Cy5-GCC TCG CTG CCG TCG CCA (SEQ ID NO: 40)) and DNA4 (Cy3-TGG CGA CGG CAG CGA GGC-$T_{20}$ (SEQ ID NO: 45)). The PcrA-RepD interaction assay involved preparation of the RepD-oriD DNA adduct as described in Slatter et al (2009) supra. A biotinylated oriD DNA substrate was constructed by annealing oligonucleotides DNA1 (CTA ATA GCC GGT TAA GTG GTA ATT TTT TTA CCA CCC AAA GCC TGA AGA GCT AAT CGT TCG G (SEQ ID NO: 46)) and DNA2 (biotin-CCG AAC GAT TAG CTC TTC AGG CTT TGG GTG GTA AAA: AA TTA CCA CTT $T_{15}$ (SEQ ID NO: 47)). In one chamber, only oriD DNA (50-100 pM) was immobilized on the surface. In a second chamber the RepD-oriD DNA adduct was immobilized. 100-500 pM dual labeled PcrA-DM1 was injected into the chambers in buffer B (10 mM Tris [pH7.5], 10% glycerol, 15 mM NaCl, 50 mM KCl, 5 mM $MgCl_2$, 3.4 mM Trolox, 1% (v/v) gloxy, 0.2% (w/v) glucose). Short movies of multiple chamber regions were recorded. Since the two Cys residues of PcrA-DM1 were randomly labeled with Cy3-Cy5 mixture, each movie contained a brief initial 633-nm laser excitation period to determine the molecules with a fluorescent Cy5, followed by turning on the 532-nm laser for Cy3 excitation. Only the PcrA-DM1 molecules with a colocalized donor-acceptor pair were factored in the $E_{FRET}$ histograms.

smFRET signals were acquired by an Andor EMCCD camera operated with a custom software at 16-100-ms time resolution. $E_{FRET}$ was calculated as described in R. Roy, S. Hohng, T. Ha, A practical guide to single-molecule FRET. *Nat Methods* 5, 507-516 (2008). Unwinding periods were measured as described in the text. The fraction of unwinding events was calculated as the proportion of the all DNA binding events that displayed an $E_{FRET}$ increase phase. Error bars were calculated according to Clopper-Pearson binomial proportion confidence interval method (C. J. Clopper, E. S. Pearson, The use of confidence or fiducial limits illustrated in the case of the binomial. *Biometrika* 26, 404-413 (1934)).

Example 6. Optical Tweezers Assay

The optical trap handle was a 6098-bp long DNA, amplified from λ-phage DNA and flanked by a 5'-biotin and a 3'-$(dT)_{10,15,75}$ overhang (SEQ ID NOS 33-35, respectively) on the other end. First, a 5'-tailed 6083-bp fragment was amplified by the auto-sticky PCR reaction (J. Gal, R. Schnell, S. Szekeres, M. Kalman, Directional cloning of native PCR products with preformed sticky ends (autosticky PCR). *Mol Gen. Genet.* 260, 569-573 (1999)) using primers P1 (biotin-GGC AGG GAT ATT CTG GCA (SEQ ID NO: 48)) and P2 (GAT CAG TGG ACA GA-abasic-A AGC CTG AAG AGC TAA TCG TTC GG (SEQ ID NO: 49)). Subsequently the amplicon was annealed and ligated with oligonucleotide DNA5 (TTC TGT CCA CTG ATC-$(T)_{10,15,75}$ (SEQ ID NOS 50-52, respectively)) to create the 3'-overhang for the initial helicase binding (10, 15 or 75-nt, as specified in figures). DNA beads were prepared by adding biotinylated 6-kbp DNA to the streptavidin-coated polystyrene beads (0.79 μm in diameter, Spherotech, Lake Forest, Ill.), and incubated at 25° C. for 30 min. Protein samples were pre-incubated with biotinylated anti penta-histag (SEQ ID NO: 44) antibody (Qiagen, Valencia, Calif.) on ice for 1 hour. One microliter of this mixture, 1 μl of streptavidin beads, and 8 μl buffer (100 mM Tris-HCl [pH 7.5], 100 mM NaCl, 10% glycerol (v/v)) were mixed and incubated for 30 min on ice to make the protein coated beads. Reactions were performed in laminar flow chambers that were designed and assembled as described in Z. Qi, R A. Pugh, M. Spies, Y. R. Chemla, Sequence-dependent base pair stepping dynamics in XPD helicase unwinding. *Elife (Cambridge)* 2, e00334 (2013). Reaction buffer C consisted of 100 mM Tris pH 8.0, 15 mM NaCl, 10% (v/v) glycerol, 10 mM $MgCl_2$, and an oxygen scavenging system (100 μg/ml glucose oxidase, 20 μg/ml catalase, and 4 mg/ml glucose) to reduce photo damage to the sample (M. P. Landry, P. M. McCall, Z. Qi, Y. R. Chemla, Characterization of photoactivated singlet oxygen damage in single-molecule optical trap experiments. *Biophysical journal* 97, 2128-2136 (2009)). The reaction chamber contained two laminar streams of buffer C with different ATP, ATP-γS and SSB concentrations as described in the text. The dual-trap optical tweezers were set up and calibrated as described in (C. Bustamante, Y. R. Chemla, J. R. Moffitt, *High-resolution dual-trap optical tweezers with differential detection*. Single-molecule techniques: a laboratory manual (Cold Spring Harbor Laboratory Press, Cold Spring Harbor, N.Y., 2008); K. Berg-Sørensen, H. Flyvbjerg, Power spectrum analysis for optical tweezers. *Review of Scientific Instruments* 75, 594-612 (2004)). All measurements were recorded at 100 Hz with a custom LabView software (8.2; National instruments, Austin, Tex.) and smoothed with a 100 Hz boxcar filter. In the "force-feedback" mode, unwinding was allowed to occur against a constant force of 10-22 pN (as specified). The contour length of DNA was calculated from the measured force and end-to-end extension of the molecule and using the worm-like chain model (persistence length of 53 nm, stretch modulus of 1,200 pN and distance per base-pair of 0.34 nm). The velocity of DNA unwinding in the force feedback mode was determined from a linear fit of the contour length of DNA in a sliding window of 0.2 s (21 data points). Pauses longer than 0.2 s were removed and then the velocity was averaged in 1 s bins. Error for the fraction of unwinding events per tether formation was calculated with the Clopper-Pearson binomial proportion confidence interval method (Clopper et al. (1934) supra)).

The force dependence of Rep-X unwinding activity was measured in the "fixed-trap" mode, by stopping the force feedback. The force data (100 Hz) was smoothed with a gaussian filter (by applying a 33-Hz moving average filter 10 times). Paused regions (velocity <10 bp/s) were removed. The pause-free unwinding velocities were calculated and normalized by the velocity at 20 pN for each molecule, and binned against the dynamic force values up to 60 pN to create the $V_{norm}$ vs. F plot (FIG. 3F). We previously found that the force response of our trap was linear against bead displacements up to 72 nm (determined in a separate experiment measuring where the force vs. extension curve of dsDNA started to deviate from the theoretical worm like chain. At a trap stiffness of 0.167 pN/nm, the deviation occurred above 12 pN). Hence we calculated the maximum reliable force to be at least 59 pN at a trap stiffness of 0.82 pN/nm.

Example 7. Ensuring Monomeric Rep-X Activity in Optical Tweezers Assay

We considered the possibility that the highly processive unwinding observed in our optical tweezers assay was caused by multiple Rep-X acting on the same DNA. If multimeric Rep-X had been required for highly processive unwinding, then the majority of binding events (i.e. formation of a tether) would not have displayed unwinding activity, because single Rep-X binding is the statistically the most probable event during the brief period of contact between the two beads. However, the majority of tethers formed displayed highly processive unwinding, suggesting that the processive unwinding is caused by a single Rep-X protein.

To further establish that the unwinding of the 6-kbp DNA was achieved by single Rep-X molecule, we repeated the experiment using beads incubated in lower concentrations of Rep-X, thus decreasing the number of Rep-X molecules per bead. Consequently, Rep-X binding (tether formation) took longer and required more trials of bumping the two beads. As the Rep-X concentration was lowered. (20 nM, 4 nM and 0.4 nM) during the pre-incubation with 20 nM biotinylated antibody, the efficiency of tether formation was also reduced (7 out of 11, 9 out of 27 and 2 out of 16 beads, respectively). However, the subsequent unwinding was still the prevalent behavior (7 out of 7, 8 out of 9 and 2 out of 2 tethers, respectively).

As another test to ensure that the highly processive unwinding was due to a single Rep-X molecule, not multiple molecules, we compared the unwinding reaction of DNA with 75 nt vs. 10- and 15-nt 3' overhangs. Since the footprint of Rep is reported to be 8-10 nt (S. Korolev, J. Hsieh, G. H. Gauss, T. M. Lohman, G. Waksman, Major domain swiveling revealed by the crystal structures of complexes of *E. coli* Rep helicase bound to single-stranded DNA and ADP. *Cell* 90, 635-647 (1997)), 10 or 15-nt overhang would increase the chance of single Rep-X binding. Rep-X exhibited the same highly processive behavior on the short overhang DNA molecules (17 out of 18 tethers formed with 10- and 15-nt overhang DNA vs. 21 out of 22 tethers formed with 75 nt overhang DNA, FIG. 3B, C), further indicating that the high processivity of unwinding is the property of a Rep-X monomer.

To test the possibility that the unwound ssDNA interacted with additional Rep-X on the bead surface, possibly increasing the processivity of unwinding, we added 66 nM of *E. coli* ssDNA binding protein (SSB) in the unwinding reaction stream in order to render the unwound ssDNA inaccessible to other Rep-X molecules. Inclusion of SSB did not change the highly processive behavior of unwinding (17 out of 18 tethers formed in the absence of SSB vs. 21 out of 22 tethers formed in the presence of SSB, FIG. 3B), suggesting that DNA unwinding by Rep-X is highly processive whether the unwound ssDNA is sequestered by SSB or not. This observation is probably due to the design of the dual optical tweezers assay, in which the DNA is under tension only between the "front runner" Rep-X molecule and the streptavidin on the other bead. Binding of a second. Rep-X to the already unwound ssDNA should not affect the measurements because the second Rep-X, which is also tethered to the bead, cannot interact with the front runner that is tethered elsewhere on the bead.

Example 8. Selection of Crosslinking Sites and Crosslinker Length

Open (inactive) and closed (active) form crystal structures of Rep and similar helicases were used as a visual guide. The target residue pair for crosslinking and the crosslinker were selected based on these criteria.

One target residue of the target residue pair should be located on the mobile 2B domain and the other target residue should be located on the immobile body of the helicase (for example on 1B or 1A domains). Preferably, target residue pair should not be part of functional helicase motifs known in the literature to prevent detrimental effects of amino acid engineering. Preferably the target residue pair should not be conserved residues. Preferably the target residue pair should be as far away as possible from the ssDNA binding sites. These measures reduce the potentially detrimental effects of the target residue mutations and crosslinking on the basic translocation function of the helicase.

The target residues should be as close as possible to each other in the closed (active) conformation of 2B domain, and at the same time should be as far as possible from each other in the open (inactive) conformation. For example, the distance between the target residue pair should be less than 15 Å in the closed form (measured from alpha carbon coordinates) and should increase by more than 30 Å during transition to open form, so that a short crosslinker can prohibit the transition to an inactive (open) form. Residues that satisfy such criteria can be determined for helicases with known crystal structures in closed or open forms.

By sequence alignment, the corresponding crosslinking target residues can be found in helicases with unknown structures to convert those to superhelicases, as well. Sequence homology models can also be employed.

Target residues should be preferably on the surface of the protein, and their side chains should be facing outward and more preferably facing toward each other.

The crosslinker should be as short as possible, preferably only long enough to efficiently link the target residue pair in the desired conformation. Crosslinker length should be considerably shorter than the distance between the target residues in the unwanted conformation.

A representative 56 Rep homologs/orthologs with 90% identity to and 80% overlap are shown in Table 4, which are also shown in FIGS. 9A-G. The target residues of FIGS. 9A-G were selected from one residue from domain 1A or domain 1B, and one residue from domain 2B which satisfy the all these considerations. For PcrA, or a homolog thereof, the target residues are selected from residues 92-116 of domain 1A or 178-196 of domain 1B, and 397-411, 431-444 or 526-540 of domain 2B. For Rep, or a homolog thereof, the target residues are selected from 84-108 of domain 1A or 169-187 of domain 1B, and 388-402, 422-435 or 519-536 of domain 2B. For UvrD, or a homolog thereof, the target residues are selected from residues 90-114 of domain 1A or 175-193 of domain 1B, and 393-407, 427-440 or 523-540 of domain 2B.

TABLE 4

| Rep homolog | Organism |
| --- | --- |
| REP_BUCAP | *Buchnera aphidicola* subsp. *Schizaphis graminum* (strain Sg) |
| REP_BUCAI | *Buchnera aphidicola* subsp. *Acyrthosiphon pisum* (strain APS) (*Acyrthosiphon pisum* symbiotic bacterium) |

TABLE 4-continued

| Rep homolog | Organism |
| --- | --- |
| REP_ECOLI | *Escherichia coli* (strain K12) |
| REP_HAEIN | *Haemophilus influenzae* (strain ATCC 51907/ DSM 11121/KW20/Rd) |
| REP_SALTY | *Salmonella typhimurium* (strain LT2/ SGSC1412/ATCC 700720) |
| A0A077ZIR6_TRITR | *Trichuris trichiura* (Whipworm) (*Trichocephalus trichiurus*) |
| S3IEG5_9ENTR | *Cedecea davisae* DSM 4568 |
| J1R585_9ENTR | *Kosakonia radicincitans* DSM 16656 |
| K8ABZ8_9ENTR | *Cronobacter muytjensii* 530 |
| A0A060VJ91_KLEPN | *Klebsiella pneumoniae* |
| A0A090V5M6_ESCVU | *Escherichia vulneris* NBRC 102420 |
| A0A083YZC2_CITAM | *Citrobacter amalonaticus* |
| A0A0J6D7T8_SALDE | *Salmonella derby* |
| A0A085ITL8_RAOPL | *Raoultella planticola* ATCC 33531 |
| E7T4Q1_SHIBO | *Shigella boydii* ATCC 9905 |
| A0A085GMM2_9ENTR | *Buttiauxella agrestis* ATCC 33320 |
| A0A085HAK1_9ENTR | *Leclercia adecarboxylata* ATCC 23216 = NBRC 102595 |
| D4BE16_9ENTR | *Citrobacter youngae* ATCC 29220 |
| A0A0H5PMJ7_SALSE | *Salmonella senftenberg* |
| A0A0J1JQT3_CITFR | *Citrobacter freundii* |
| A0A0J8VI05_9ENTR | *Cronobacter* sp. DJ34 |
| F5S3F4_9ENTR | *Enterobacter hormaechei* ATCC 49162 |
| D2ZMA5_9ENTR | *Enterobacter cancerogenus* ATCC 35316 |
| A0A084ZTW9_9ENTR | *Trabulsiella guamensis* ATCC 49490 |
| A0A038CLT3_RAOOR | *Raoultella ornithinolytica* (*Klebsiella ornithinolytica*) |
| Q8Z385_SALTI | *Salmonella typhi* |
| Q83IX8_SHIFL | *Shigella flexneri* |
| A0A0D5WYP4_9ENTR | *Klebsiella michiganensis* |
| A0A0H3FM31_ENTAK | *Enterobacter aerogenes* (strain ATCC 13048/ DSM 30053/JCM 1235/KCTC 2190/ NBRC 13534/NCIMB 10102/NCTC 10006) (*Aerobacter aerogenes*) |
| A0A0H2WUK6_SALPA | *Salmonella paratyphi* A (strain ATCC 9150/ SARB42) |
| A0A0H3H1F3_KLEOK | *Klebsiella oxytoca* (strain ATCC 8724/DSM 4798/JCM 20051/NBRC 3318/NRRL B-199/KCTC 1686) |
| X7I146_CITFR | *Citrobacter freundii* UCI 31 |
| A0A0H3CTF5_ENTCC | *Enterobacter cloacae* subsp. *cloacae* (strain ATCC 13047/DSM 30054/NBRC 13535/ NCDC 279-56) |
| D2TH67_CITRI | *Citrobacter rodentium* (strain ICC168) (*Citrobacter freundii* biotype 4280) |
| Q329V6_SHIDS | *Shigella dysenteriae* serotype 1 (strain Sd197) |
| W6J7C4_9ENTR | *Kosakonia sacchari* SP1 |
| I2BE87_SHIBC | *Shimwellia blattae* (strain ATCC 29907/ DSM 4481/JCM 1650/NBRC 105725/ CDC 9005-74) (*Escherichia blattae*) |
| B5EZ38_SALA4 | *Salmonella agona* (strain SL483) |
| A0A0F5SGU2_CITAM | *Citrobacter amalonaticus* |
| G9YY11_9ENTR | *Yokenella regensburgei* ATCC 43003 |
| A0A090UXU3_9ENTR | *Citrobacter werkmanii* NBRC 105721 |
| A9MJ31_SALAR | *Salmonella arizonae* (strain ATCC BAA-731/ CDC346-86/RSK2980) |
| Q3YVI6_SHISS | *Shigella sonnei* (strain Ss046) |
| D3RHB6_KLEVT | *Klebsiella variicola* (strain At-22) |
| Q57HT8_SALCH | *Salmonella choleraesuis* (strain SC-B67) |
| B5RFS5_SALG2 | *Salmonella gallinarum* (strain 287/91/NCTC 13346) |
| A0A089Q204_9ENTR | *Cedecea neteri* |
| A0A0H3BNR1_SALNS | *Salmonella newport* (strain SL254) |
| C9Y4T0_SICTZ | *Siccibacter turicensis* (strain DSM 18703/ LMG 23827/z3032) (*Cronobacter turicensis*) |
| B7LU77_ESCF3 | *Escherichia fergusonii* (strain ATCC 35469/ DSM 13698/CDC 0568-73) |
| A0A0H3TAW8_SALEN | *Salmonella enteritidis* |
| G2S5J6_ENTAL | *Enterobacter asburiae* (strain LF7a) |
| A0A0F7JC30_SALET | *Salmonella enterica* I |
| A7MQI4_CROS8 | *Cronobacter sakazakii* (strain ATCC BAA-894) (*Enterobacter sakazakii*) |
| L0M8J0_ENTBF | Enterobacteriaceae bacterium (strain FGI 57) |
| A0A0K0HFU2_SALBC | *Salmonella bongori* (strain ATCC 43975/ DSM 13772/NCTC 12419) |

TABLE 4-continued

| Rep homolog | Organism |
|---|---|
| A8ACT1_CITK8 | *Citrobacter koseri* (strain ATCC BAA-895/CDC 4225-83/SGSC4696) |

Use of shorter crosslinkers increase the efficiency of crosslinking reaction by favoring the intramolecularly crosslinked species rather than intermolecularly crosslinked multimeric species. These rules also ensure that the 2B domain is restricted to the active (closed) conformation, and cannot attain an open (inactive) conformation. Thus conformational control is achieved, and the possibility of 2B domain to swinging open to access an inactive (open) conformation is virtually eliminated.

Without being bound by theory, one possible explanation for the super activation would be the decreased dissociation rate due to the crosslinked protein encircling the ssDNA strand (indicated by the crystal structure, so that the protein cannot dissociate from the ssDNA easily. However, it was found that despite both Rep-X and Rep-Y encircling the ssDNA (as indicated by the crystal structure), only Rep-X was super-active. Thus, in order to create the super active helicase, immobilization of the correct conformational state of the 2B domain is necessary.

Example 9. Identifying Suitable Crosslinking Sites in Homologous Helicases

Based on the crosslinking target site selection criteria established in Example 8, potential crosslinking target residues in helicases were determined using known crystal structures. By sequence alignment and structural homology modeling, the corresponding crosslinking target residues are identified in helicases with unknown structures. Subsequently these helicases can be converted to superhelicase forms. For example, based on the criteria that the distance between the target residue pairs should be less than 15 Å in closed form and should increase by more than 30 Å in open form, we identified the residues in Rep, PcrA and UvrD helicases as shown in FIGS. 9A-G. Homologous helicases are identified, for example, by 50% sequence identity and 80% overlap to the helicase with the known structure. For example, we found 3147 such proteins homologous to *E. coli* Rep, 1747 proteins homologous to B. st PcrA, and 1209 proteins homologous to *E. coli* UvrD helicases were found (Tables 5-7, respectively). Then the corresponding crosslinking residues are identified in any of the homologs. For example, we chose an example of 56 Rep homologs (Table 4), and found the regions where the crosslinking residues can be engineered (FIGS. 9A-G). Despite the fact that the three model superfamily 1 helicases, UvrD, Rep and PcrA, have only 35-40% sequence identity, they exhibit >90% structural homology according to their crystal structures. Hence it is reasonable to expect a highly similar structural homology from the proteins with 50% identity to and 80% overlap to the helicase with the known crystal structure; these are suitable candidates for crosslinking in the superhelicase (-X) form.

*E. coli* UvrD (ecUvrD) has 33% sequence identity with *E. coli* Rep (ecRep) and 42% sequence identity with *Bacillus stearothermophillus* PcrA (bsPcrA). Highlighted regions in FIGS. 9A and 9G show the crosslinking sites obtained from the open form and closed form crystal structures and the criteria established in Example 8. These regions align well in the sequence showing that a sequence alignment can be used in helicases with unknown structures to determine the crosslinking target sites in helicases with unknown structures. For example, the crosslinking regions (boxed sequences of FIG. 9G) in *D. radiodurans* UvrD (drUvrD) were found by aligning its sequence to bsPcrA, ecRep and ecUvrD, 1A/1B residues: 92-116, 182-200, 2B residues: 400-414, 434-447 and 528-544. drUvrD (Q9RTI9) has 33%, 36% and 41% sequence identity to bsPcrA, ecUvrD and ecRep, respectively. These four proteins have 21% sequence identity as a group. Only closed form crystal structures of drUvrD are known. Boxed regions shown in FIG. 9G are shown in the crystal structure of drUvrD (FIG. 11) to demonstrate the suitability of the regions for crosslinking.

*D. radiodurans* UvrD (drUvrD, Q9RTI9_DEIRA) has only 1 Cys residue, and a crystal structure is known. drUvrD has 31 entries in the 50% identity cluster of the Uniprot database, some of which are mildly thermophilic (40° C.-68° C.; optimum growth at 60° C.), making them better candidates for helicase dependent nucleic acid amplifications. In certain exemplary embodiments, a suitable UvrD helicase is selected from following species: *Deinococcus geothermalis, Meiothermus* sp., *Marinithermus hydrothermalis, Marinithermus hydrothermalis, Oceanithermus profundus*. Selected thermophilic ortholog species of drUvrD are shown in Table 8.

In another embodiment, the helicase is selected from those shown in Tables 9 and Table 10.

TABLE 5

List of 3137 unique non-redundant helicases that have 50% sequence identity and 80% overlap with *E. coli* Rep. (Uniref50_P09980 cluster, citable UniProtKB and UniParc accession numbers are shown).

| P09980 | UPI00051877AD | UPI00050997D4 | A0A063KTD1 | W0QF97 | A0A0C3I5L6 |
|---|---|---|---|---|---|
| A0A0G3HMG0 | UPI0002CB7C3E | UPI00041BBC9F | A0A0F9UW26 | A3MZ01 | UPI0005EDEB6E |
| A0A069YUU2 | UPI0002CB6CB4 | Q31J65 | UPI00057A0DA3 | A0A0A7MFM3 | Q4F7B3 |
| A0A069XK09 | UPI0003EF7150 | UPI0004A7511F | UPI00042735E9 | UPI00037127A9 | H2IB31 |
| A0A090J554 | A0A0B5IRM0 | J3VUI0 | A0A0B2JU34 | W0QB54 | UPI00039DFE76 |
| J2LMP0 | UPI0005F8A649 | B3PF82 | A0Y242 | D9P8T6 | UPI0002D3CD90 |
| A0A0E1CLG8 | UPI00036A6E72 | W1J4L6 | G7F259 | B0BT27 | UPI00031FC355 |
| W8VIF4 | E7T4Q1 | A0A068QMH5 | F3BJI5 | E0EII5 | A0A034TPW5 |
| A0A0J2JAV4 | UPI0002C94EDF | UPI000645DEF6 | UPI0004641B09 | A0A011P892 | UPI0003B1A99F |
| A0A0H4Z590 | UPI0004A19D90 | A0A0J1C9T2 | W1Z619 | UPI00047C9D5E | A0A090P8C9 |
| A0A0H4YMK4 | A0A024KL85 | A0A077P2A7 | N6W1D7 | W0QMN7 | U3AJD4 |
| A0A0H4ZZ54 | A0A029K3Y0 | A0A077PGN3 | G7EU46 | B3H0C1 | A0A0H0Y6H0 |

TABLE 5-continued

List of 3137 unique non-redundant helicases that have 50% sequence identity and 80% overlap with
E. coli Rep. (Uniref50_P09980 cluster, citable UniProtKB and UniParc accession numbers are shown).

| | | | | | | |
|---|---|---|---|---|---|---|
| W1HB14 | A0A029LST3 | A0A077Q5V6 | UPI0003F6330E | E0FKS8 | D0WV97 | |
| A0A0H4ZHU7 | A0A074IDU1 | A0A0B6XFA1 | UPI0004175A32 | E0E690 | UPI00039CA46E | |
| A0A0G3T252 | A0A070UMT6 | D3VHW6 | G7EBR9 | E8KIM6 | K5UKZ2 | |
| A0A0H3GKB6 | A0A0H0NZ89 | N1NN52 | UPI0002317DDE | KOFXU5 | A0A061Q0T1 | |
| A0A0K0GSG9 | UPI0004DACF34 | A0A0A8NWA1 | UPI000412695D | A0A0D6UGN8 | D0X594 | |
| A0A0G8G0X7 | UPI000543FDCF | W1J8H9 | A0A099L6T2 | M9X512 | UPI0006814400 | |
| A0A060VJ91 | A0A0H3MJI3 | A0A077NN58 | UPI0002DA5F7A | D9P4Y2 | UPI0006AA085C | |
| W1HUU8 | UPI0002A2C4E1 | A0A068RA85 | UPI0003162143 | UPI0002556C8C | UPI00039C63E0 | |
| W1EG06 | A0A0H0KMW7 | A0A0A8LWM3 | U1MBQ7 | A0A0B0HCL6 | UPI0005EFDC1A | |
| W1HYL7 | F4NQI1 | A0A077PLN5 | U1JK11 | UPI00041A33FA | UPI0063C4F58 | |
| W1EC12 | A0A0G9FGL3 | A0A077PEC1 | U1IZP2 | A0A081FYF7 | UPI0002B70576 | |
| V0AP50 | UPI0005305422 | D3V6L9 | Q3IJF4 | A0A0B3BWV0 | UPI00023755B4 | |
| W1E3B2 | I2X0N8 | A0A0J5FTN5 | E6RJ61 | A0A0B2DBM6 | UPI00069FBA0A | |
| A0A080SZ33 | UPI00063C108B | A0A077N2X7 | Z9K3Y4 | UPI00337D905 | A7K6B6 | |
| A6TGG4 | UPI00053AB8E4 | UPI00037EA902 | G7G5E8 | D2TCP1 | U4DZN2 | |
| W1BG54 | UPI000390341B | A0A094NXP4 | UPI00034C744C | UPI0001960924 | L8XB50 | |
| Q57HT8 | UPI0002C97E36 | F9QBX8 | A0A0F4PWX2 | V5Z3P5 | UPI0005975B9F | |
| C0Q2V7 | T8JFG3 | UPI000364DEC7 | I3CJI7 | UPI0065FAA51 | UPI00039C5A41 | |
| A0A0G2NT58 | A0A0J0IRL7 | A3V094 | A1T091 | UPI00054F6EBB | UPI0005F0AEC8 | |
| V2QUW5 | J1GHC8 | UPI0002D3C2F3 | UPI00036133E4 | UPI000554232A | A7N1B5 | |
| B5RFS5 | UPI0005EFAD7E | F9SI11 | A0A0A8UTG2 | UPI00044B0A82 | U4K9S4 | |
| H3N5E4 | A0A0D7LCG7 | UPI0065FA69F | UPI0002624F9F | W0T2G5 | U3ATU8 | |
| UPI0030AD7A3 | UPI0005EFAEC1 | UPI0003122A61 | UPI000465C470 | A0A014LYL5 | A0A0C1YTU5 | |
| A0A0J2K868 | UPI00058EBC4A | UPI00030ED944 | UPI0004E14814 | E3DCZ6 | A6AVT6 | |
| A0A0E2RBB6 | A0A0J5E886 | UPI0003151B6B | A3YC72 | UPI00069D7BD3 | UPI0003B1A0B5 | |
| A0A0G3S4X6 | UPI0004D3B9EA | UPI0002EE9ECE | A0A0F4QZY4 | D8MKR6 | UPI0006A5B784 | |
| A0A0H3H1F3 | UPI0005B485C4 | F6CZU1 | UPI00036B36CA | UPI00058F6E3E | A0A0D0JDJ7 | |
| A0A068HB64 | V2SM85 | A6W1H3 | B5JVS4 | I3IF96 | UPI00069EC01E | |
| A0A0J8Z8W0 | UPI0003AC5FE5 | X7E960 | M4U1U4 | UPI00066FB81F | UPI0006A5FC2D | |
| UPI00066AC9B7 | UPI00057BEBAB | W1RWL7 | A0A0E4C1E5 | UPI0005866DF0 | UPI00026C4ED4 | |
| H3MDG6 | A0A0C2ELY7 | UPI00037950B0 | C4K8X2 | UPI00037B74A6 | UPI0005EF44E2 | |
| UPI0002F9F873 | U9Y0B8 | A0A0J8GYA3 | UPI0004762303 | V5VG28 | UPI0005EFA2F9 | |
| A0A0A0FJZ3 | A0A0H0JVJ4 | UPI0003F7784F | UPI000558F88A | D0C9R6 | A0A0C1Z376 | |
| A0A077ZIR6 | UPI0002CC3FC4 | I1E2U9 | A0A0E9M3L1 | A0A014AME8 | A0A061PWI7 | |
| A0A0H7U3H0 | A0A0D1Q3M4 | Q0VLG2 | UPI000415F58C | A0A062IS38 | A0A090RFC6 | |
| A0A0H7UZL4 | N2JD25 | B4X088 | UPI0003736C3A | A0A062RV86 | F7S1D5 | |
| W1YGM8 | N3FAJ0 | A0A095S578 | UPI00047DD116 | A0A014QUN9 | UPI00037B6B31 | |
| W1F515 | D7XDE9 | U7FXU8 | UPI00051B59BB | A0A0J1AD48 | UPI0004DB80FB | |
| W1AVB8 | J1R585 | L0W9M5 | A3WIV3 | A0A011J490 | UPI00002559C1C | |
| UPI00050B4286 | A0A063XPH7 | A0A095SJP8 | UPI00058ED431 | A0A009L4W9 | UPI0004226D1B | |
| UPI000699BCA0 | UPI00046E61E1 | UPI0003096010 | A0A0B7IYA3 | A0A062ET27 | UPI0005A04CC3 | |
| UPI0001BCF307 | UPI0005CFB922 | Q5QZ79 | A0A0D7FE58 | A0A062B4C4 | UPI00036751C4 | |
| UPI000291E920 | F1ZPM5 | A0A0B4XU81 | N2J9F8 | K6NBZ9 | UPI0004A71315 | |
| UPI0005CECD30 | E9Z170 | V4LHL4 | H0JBY0 | A0A062HCL9 | G7LUC7 | |
| UPI0006994S5E | I2RDB4 | UPI00048D495E | UPI000307EC21 | U1UEQ4 | C6DHF7 | |
| UPI0006995E89 | G9YY11 | UPI00066EC8FC | UPI00056B6FFA | N9HSF4 | A0A0G4JUN2 | |
| A0A0H7XVC5 | UPI0005A8BE84 | A0A0E0Y6R4 | UPI00069494928A | A0A009GJZ6 | UPI0003AAB78C | |
| A0A0H7ZBU6 | B7N271 | F2G1X5 | W9SXN9 | A0A009HQM2 | UPI0003A1DD75 | |
| A0A0H8QAW7 | A0A029IHD3 | S5C3L8 | G2E0G6 | L9NZJ0 | UPI0003AA3036 | |
| T9GN10 | A0A029HDM3 | S5AI16 | H5V6K1 | A0A011IKX6 | UPI00039E8574 | |
| U9YW53 | UPI00057CAFFD | K8AD99 | A0A062FYV6 | UPI0003A8ECA5 | | |
| E1ITJ2 | UPI0005175495 | K0CYB3 | UPI0002F4EC6B | N8ZCZ6 | UPI0003A98BB4 | |
| A0A029L915 | UPI0004D67711 | K0EB21 | K8AIR9 | A0A022JJ04 | UPI00039EFED1 | |
| S0UVF6 | UPI00038F4A0A | A0A0B3Y7T5 | UPI0002F0AB46 | K1FLW5 | UPI000532BCE2 | |
| I2SR57 | UPI0004ED858A | A0A075P1K0 | UPI0003747342 | N8UCZ4 | UPI0003AAAD9F | |
| I4S298 | S1FND5 | UPI000509BB4B | A0A0D1MQD1 | A0A010EBV1 | U6ZJ94 | |
| D7ZUA2 | S1LRE3 | F5Z5Y6 | F8FZI5 | A0A009SCE5 | UPI0005539481 | |
| A0A069X2C0 | S1CH47 | UPI0003556595 | UPI0004706F0C | N9GH50 | UPI00039F0A65 | |
| F3WQ14 | L2VMG7 | A0A010PKS2 | UPI0004870A8C | A0A0J1AU91 | UPI00039CBB8 | |
| E1J5T7 | UPI0005EDE9CE | A0A0C5ITU1 | UPI0005B76FDE | A0A009JME7 | UPI00039E8082 | |
| M9FM00 | UPI0002CA0423 | UPI0005D7D9DE | UPI0004838E3B | A0A062TQ97 | UPI00039A51A2 | |
| S1HS46 | UPI0004E384CD | J2S9U8 | A0A0C5RPA5 | A0A009QEV1 | UPI00039E8236 | |
| D7YBV4 | UPI000675EB35 | UPI0002E4097E | F0E436 | A0A010UBN4 | V3TUV7 | |
| D7YG19 | V0Z8Q3 | UPI000641D99E | J3E3S1 | A0A062FMG3 | A0A0A8FH34 | |
| V0RR51 | D7ZDM9 | J3D7I1 | T2HEW7 | A0A013G992 | UPI000532D788 | |
| V0AF21 | V5B2V3 | J2T1B6 | B0KQ68 | A0A0J1A474 | D2BYS8 | |
| E9YLU8 | V1I8U1 | J3EAI0 | UPI00048196DC | N8YU24 | C6CGH3 | |
| I6CD40 | T9SAP6 | A0A0J6H1C3 | A0A084C8X6 | K6LHM0 | A0A089V9A1 | |
| E1HWT5 | A0A0I1J330 | J2MEX6 | A0A099E6T7 | A0A062DHL7 | A0A0A3ZID8 | |
| A0A070FCA9 | A0A0J3J6C1 | UPI0004653130 | A0A088NVW6 | A0A009TH79 | Q9K599 | |
| V0TJ44 | L0M8J0 | UPI000370037D | A0A0F7Y5R7 | A0A0J0ZSY5 | A0A0B2TLM6 | |
| S1H2A1 | UPI0002C957E6 | UPI00054B503C | A0A099N7M2 | F5I0P2 | E0SKR5 | |
| E6BNJ7 | UPI00033C37F9 | UPI0005A8A319 | V7DDK2 | A0A010K6Q8 | J8TIB8 | |
| D6I334 | UPI0003EF8387 | L1M697 | L0FS45 | F5IED5 | UPI00050455DF | |
| S1ESS4 | UPI00040AF69D | A0A0F4VBH8 | V9V750 | N9KF69 | A0A0B3XKC6 | |
| S1CGG8 | W8XM69 | J2XVS9 | A0A059V3S3 | S3TL87 | D0KC43 | |
| I2WCN5 | F0JWU2 | J2NB92 | B1J4P9 | A0A009MSS6 | A0A0H3IEB9 | |

TABLE 5-continued

List of 3137 unique non-redundant helicases that have 50% sequence identity and 80% overlap with E. coli Rep. (Uniref50_P09980 cluster, citable UniProtKB and UniParc accession numbers are shown).

| | | | | | |
|---|---|---|---|---|---|
| A0A070DIV3 | A0A0J2D6H5 | S6JBD8 | UPI000627A5A1 | A0A0J0ZPS4 | A0A0J5XQ16 |
| A0A079D8A1 | L5GW15 | J2UYW0 | UPI0003A45A0C | A0A010GGU7 | UPI000505D45B |
| A0A080I8Z6 | S1P4F9 | I4JZZ1 | UPI0004901875 | A0A0J0ZKR3 | A0A0J6AFU6 |
| L4IUS8 | UPI0006187646 | A0A0J8G475 | UPI000312CC5F | B0V8Y9 | A0A0B3Y0I6 |
| L3IPS4 | UPI0002CA3627 | A0A038GJS8 | V6JD09 | A0A0E1PVY4 | UPI0004E7AD0D |
| V6FPL2 | S1IH44 | J2NTP4 | A0A0C1IE71 | A0A0E0WM10 | UPI0005010995 |
| F4T625 | UPI0001FB5104 | UPI00054BC40B | U5VL93 | A3M323 | A0A0E2ZQ64 |
| A0A073VUA5 | UPI0006A60648 | A0A0J6JAQ4 | UPI0003B82996 | A0A0J0Z9E3 | A0A0J5UIH7 |
| F4V8A1 | UPI0000666D818 | A0A0J6I536 | A0A089YA93 | G2JCT3 | A0A093TZI5 |
| K3KG62 | UPI00028CDADE | K0WMX7 | N9W558 | A0A028IQG4 | A0A0B2TAM5 |
| M9E9G4 | UPI0005182B07 | UPI00069ECA48 | V9X4R6 | A0A0C0CBD9 | A0A086ER15 |
| D6JH94 | UPI000246F098 | UPI0003D2AA53 | UPI0006836835 | A0A0C0CIL5 | J7L4K8 |
| E0J414 | UPI0002CBC547 | A0A0C5ETI6 | S2KQL9 | UPI0003DF9CA6 | A0A0B2W727 |
| W8U2K7 | A0A0A5IKM0 | D7HTE0 | R9VCP0 | A0A062DT29 | A0A093S787 |
| E8Y8U4 | UPI00046F99E1 | D7HTE0 | U2U6Q9 | N8VAV1 | Q6CZD7 |
| A0A0E0U640 | UPI00066D2906 | S6JE83 | UPI000480BE0F | A0A0F3L889 | A0A0J5R7U1 |
| A0A0E1SVC5 | A0A0G3QEH2 | J2LR66 | UPI00062A24F9 | V2VX37 | A0A094RXX6 |
| A0A0E2TLG7 | W0AUJ4 | J2Q4M5 | UPI00040A96BC | V2TSL6 | UPI00057CA70B |
| C6EG35 | UPI0006A5EC48 | UPI0003FAF552 | A0A0J8UZS6 | L9MEI1 | UPI00057CDC60 |
| Q3YVI6 | R8WQW7 | UPI000289EE48 | I7BAY2 | A0A009ZWD9 | UPI0001A44592 |
| J2YVU0 | S0XDU9 | UPI0006419BD9 | A0A0A7PUM7 | N9SD17 | UPI00057F7392 |
| A7ZTX9 | UPI0002514D84 | UPI0006A612B6 | I3UUX4 | N9C3A1 | UPI000652BF86 |
| A0A0E1M3S0 | UPI0005CF34C7 | A0A0F7A011 | A5WAY2 | UPI0004497B0F | UPI0002D49EE5 |
| I6BAF2 | UPI0005AA6C75 | F3JF49 | Q88CB7 | UPI0002BB404B | U1LCU7 |
| A0A090NEE8 | UPI0002CB348F | L7H1R3 | A0A0A7JV78 | UPI0004457216 | U1JRW9 |
| A0A0A7A0X5 | UPI0003901AF0 | Q500M3 | UPI000417E5AB | UPI00044C3A7B | A0A0F4P9F7 |
| E2X573 | N2Q8R5 | S3NDD8 | Q1I2W2 | A0A0A7XTN0 | A0A0F4PG18 |
| Q329V6 | UPI0003B29D20 | F3GZK5 | UPI0004A76E61 | A0A022ILU3 | A0A0C1LH68 |
| F4TMM3 | UPI0005F81F2E | UPI0005CA31AB | A0A0E9ZS43 | A0A066PI57 | UPI00061D116D |
| U9YTK0 | UPI0002CA5EAC | UPI00035D1EA1 | UPI000615E3F7 | A0A062G9S1 | A0Y9C9 |
| B3X5G0 | UPI000462FEC5 | W0MPM6 | A0A0H5W4I1 | L9LZ08 | Q2S8F2 |
| I6CYC2 | A0A070DGP2 | A0A0A1Z8J9 | A0A0H6ING7 | A0A010KUF7 | K2JN56 |
| A0A0A0GP02 | S3IEG5 | W2DE98 | UPI00069F04C6 | K9BCT1 | UPI00067E742C |
| F4SRI4 | UPI0002CC411A | A0A0F4TYK8 | UPI0053BC90E | A0A0E2G0N2 | A0A084IL47 |
| UPI0006981AFC | UPI00005718CCF | UPI00041035FD | UPI00069E6D92 | A0A0E2GP36 | IJPT0006697E7E |
| V0ST83 | UPI00036A6951 | F2ZPZ1 | A0A0H7D3K2 | UPI00044F9626 | C9PMC5 |
| T8WTG6 | UPI0002A38058 | UPI00045100E9 | D2YQS5 | UPI00044ACF5B | UPI000402FD5E |
| A0A071C0Z5 | A0A0I1VLP8 | UPI0006458FD3 | D2YET1 | UPI00044D2485 | UPI0004802687 |
| V0XTH9 | UPI0002CB6DE1 | A0A098SWG7 | A0A085TFB6 | UPI0005AB250E | H0PYR0 |
| D8C4A4 | T5NUB4 | A0A0D1NXC0 | UPI00051D019F | UPI00044F9882 | UPI00037C100B |
| T9AU26 | A0A0D7F5Y8 | UPI000589F9C7 | A0A0F2IJ11 | A0A013NSE0 | UPI00067D4203 |
| E1HNU3 | A0A070RX93 | UPI000614591D | UPI00050288CA | UPI0003558246 | UPI0002FE41B0 |
| H4URG0 | H3MUT6 | UPI000370CF7F | A0A099MUD3 | A0A062L2N7 | UPI00005BC9A68 |
| A0A070SPZ6 | A0A070H7B2 | UPI00061DB54E | UPI00042A59FC | A0A014DQT7 | A0A0J6NLY1 |
| A0A073HDV7 | UPI00025B202A | UPI00048A25A1 | C9QBF3 | A0A014BGK8 | A0A0J6KGG3 |
| S1HND8 | A0A064CY65 | UPI000463D380 | UPI00028D4D13 | A0A014E4S6 | UPI0005BBAD58 |
| A0A079FCR6 | UPI0004D5922D | A0A0F4SXJ2 | A0A085PFD0 | UPI0002FB179F | B0UTK9 |
| A0A073UI24 | UPI00038FE44C | E2Y0S2 | UPI0002F9A474 | A0A0B2XRW1 | Q0I2R4 |
| V6FCI2 | UPI00057C0F18 | UPI00054B1EC3 | UPI0005C96744 | N8S5C9 | A0A0F6RAV7 |
| W1BJG8 | UPI0004D7032E | A0A0J6KIB8 | A0A0H6I9T4 | UPI0004537654 | B7S2C9 |
| A0A064T0J2 | A0A0J4XAT3 | UPI0004157785 | A0A0H3AKZ5 | UPI0004526A41 | H1G3C3 |
| A0A070Y1X0 | UPI0002C8F3D6 | UPI0003D1029 | A0A0H3QD21 | A0A014CAF7 | UPI00048A6F57 |
| A0A073GI88 | UPI00061449A9 | UPI00046A96D2 | Q9KVH9 | UPI00061AF1D4 | K2KA81 |
| V8KBQ0 | A0A0F5SGU2 | UPI000287BEB4 | C3LQ06 | UPI000665B4E7 | UPI0005A75154 |
| A0A070NWA9 | A0A0C1ZV53 | UPI10004882B64 | UPI00053C3831 | N9IYA6 | A0A0F6KJ15 |
| A0A071AHD9 | UPI0002CB0481 | UPI0004937205 | A0A0H6DK35 | A0A062KZU0 | UPI00053802DA |
| A0A079GY22 | A0A029P5M4 | A0A0B8VQT6 | A0A0H6WUV7 | UPI0005A67365 | A0A0E2LUW8 |
| A0A074HJN3 | UPI0002A43CB4 | UPI0004E6F9D0 | UPI0000F34C0E | A0A013IDC6 | K1JFB9 |
| V1AR00 | C9Y4T0 | UPI0005B4FF04 | A0A0H6U8U2 | A0A013P0S9 | A0A023RRT0 |
| A0A080HY13 | UPI00049ED8E4 | K9NS95 | UPI00069E3D50 | A0A009LQZ8 | UPI0005AA85F9 |
| L3QA81 | R5WQS0 | J2QIN9 | UPI00069F740E | A0A062FFT3 | UPI0005AA6DC7 |
| I2X3U6 | UPI0002C9A11F | S6I847 | UPI00069D81D6 | UPI00056E426A | UPI0005CE86ED |
| L3K8G1 | UPI0003901F07 | A0A085URN7 | UPI000472B301 | A0A009EYA5 | K1K4T1 |
| A0A080GHT9 | K8CHU4 | UPI0006762E20 | UPI0005B3F2F7 | Q6FDR1 | UPI0005C13448 |
| A0A070PMD4 | F5VKN6 | A0A0D6C968 | UPI000419FA2F | A0A014CQR5 | UPI00068176EC |
| A0A079FM03 | A0A0J1M6F0 | A0A0D6BRV6 | UPI00019F6F0B | A0A014FSY6 | UPI0005A8197B |
| A0A071CG57 | A0A0J1MPE2 | UPI0004659D49 | D7HG42 | A0A014DDU2 | UPI0005EE918B |
| H1C5A6 | K0XCY3 | A0A0B7DG99 | UPI0006154522 | A0A062SQW5 | UPI0005A7CCE7 |
| A0A071DLR9 | UPI0004839044F | UPI0005789654 | UPI0004E46C62 | A0A062MW11 | A0A091AMQ6 |
| V6E2G2 | UPI0002CA7454 | A0A099SK66 | A0A0D1ESY4 | F0KFL5 | A0A0A5MTL6 |
| D8AZU3 | UPI0002CA7442 | UPI0002887A69 | UPI0004A3DD97 | A0A010KWI7 | A0A070ARJ5 |
| I4J555 | UPI0002C8C519 | UPI0004E363B2 | C2HS26 | A0A009UGU89 | UPI0005B21AAA |
| D8AJN2 | UPI0002CAD3B5 | UPI0004711D03 | UPI0004939A0F | A0A009RTE6 | UPI0005B4D264 |
| L3NTU4 | UPI0005AB8E86 | A0A0C2R6G2 | UPI00041D5461 | A0A013S7D9 | UPI000206A54C |
| A0A017JGH1 | E3G401 | UPI00036390E5 | UPI00053C556B | A0A011KJ92 | UPI0005A9E387 |
| E6B0V7 | A0A0D6J066 | Q4K3U4 | UPI0006B26D10 | W3T1R8 | UPI00057A3319 |
| G0F684 | A0A0G3J3X1 | UPI000467F1C8 | UPI0003DDF141 | A0A013T0B3 | UPI00067160F8 |

TABLE 5-continued

List of 3137 unique non-redundant helicases that have 50% sequence identity and 80% overlap with E. coli Rep. (Uniref50_P09980 cluster, citable UniProtKB and UniParc accession numbers are shown).

| | | | | | |
|---|---|---|---|---|---|
| T5ZL14 | A0A0G2SEI1 | UPI00035F9085 | UPI00041C3DE6 | A0A062GLJ2 | UPI0005BE5278 |
| A0A023LHN8 | Q1R4G1 | S6MAY1 | D0IMK5 | A0A022KT37 | UPI0005B44CBF |
| B1LLV1 | A0A0H2Z4L9 | A0A0D0PI96 | UPI0004D45E01 | A0A013LNZ0 | A0A0A5LAX4 |
| A0A0G3KG39 | B7MGI8 | W8PZL5 | UPI00064AB4CA | R8YFJ5 | UPI0005A92C34 |
| A0A0E3N453 | A0A0E2KYV2 | A0A0A1HZQ3 | UPI00027344D7 | A0A010JTN9 | UPI0005AA862F |
| H9UYX9 | UPI0005AABAAC | A0A067A109 | UPI000157DCC7 | A0A062E1I9 | UPI0005589B3FB |
| W1WIT4 | UPI0005A9C3D7 | M4K6D4 | UPI00042503B9 | U4NIT0 | UPI00067ED86E |
| D2ABU8 | M8YJ27 | L7HM91 | UPI0004223C0C | A0A009MNG3 | UPI0005A81507 |
| UPI00050A88E3 | A0A084ZTW9 | UPI0003631017 | UPI000418E3F8 | A0A062M340 | UPI0005A6CF02 |
| I6FUG1 | V0V039 | Q3K4P8 | UPI0006A57310 | A0A009GIH8 | N9TZ36 |
| I6FTV3 | UPI00038FD937 | UPI000490BE66 | UPI00042555E5 | A0A013TVZ0 | UPI0003O5A965 |
| A0A0C7MGG8 | UPI0005436CE7 | A0A085VMC8 | UPI00019F31E6 | A0A010GR47 | UPI00051BB915 |
| Q83IX8 | UPI00063CF1BC | A0A0C1WQJ9 | F0LQ07 | D6JS35 | UPI00036C158E |
| A0A0G3KSI3 | A0A0D5WYP4 | V8QZB9 | UPI00041CEAFC | A0A062DGV2 | UPI0005A8ECB0 |
| A0A0F6EJW3 | UPI000448752F | A0A010RSD4 | UPI0006A6C949 | UPI000447CI58 | V9ZTN7 |
| R4Y441 | A0A017I2W6 | UPI0005C45ABE | UPI0003575C86 | UPI00044634D9 | UPI0005BA54D7 |
| C8T0L2 | R8WJV4 | A0A0J6KKN8 | UPI000218F470 | UPI000571CB80 | UPI00029B427F |
| D3H3Y7 | UPI00033B8BA8 | V9R4G1 | UPI00000408ADF6 | A0A011BSP6 | UPI00044B3D00 |
| Q0SYW8 | F5P1M9 | A0A0B4EK54 | UPI0004E46B12 | UPI000449E802 | UPI0004633883 |
| A0A0F6MJB5 | UPI0002C91A03 | F3FQI2 | UPI000427E347 | B0VTE6 | UPI00028072AE |
| UPI0002DF73BD | UPI00064025BA | UPI000497D00B | UPI0003FAAAB1 | UPI00044AA4AB | UPI0005AB7E0E |
| D2TH67 | UPI0003EF0793 | UPI000069BD02D | UPI0002BC24BA | A0A0E2GQQ9 | A0KQV9 |
| A0A0J0GM61 | I2RVV7 | UPI00062AF47B | UPI0021A9545 | K9C7H8 | T0PHI0 |
| UPI000664EF6E | UPI00057A8D97 | A0A0A4GEX8 | UPI00053C5E2E | A0A010WGE0 | UPI000589CE10 |
| UPI0006656E52 | UPI00057BF87B | A0A0H5ABK2 | UPI000424C2A2 | A0A022J6H8 | UPI0005D91456 |
| UPI00062C1AFB | UPI000579419A | UPI000066EF0F3 | UPI00002A3539C | UPI00004474D0C | UPI0006666021A |
| UPI0046642F8 | A0A0H3XA26 | UPI0005CB3DAB | UPI0002A3539C | UPI000406B18C | UPI0006A60313 |
| UPI0004E14727 | UPI0005CC970C | W0H3A6 | UPI0004112BDB | A0A013J7P7 | UPI000372D3BE |
| A0A090UXU3 | UPI0004F91B50 | UPI0001E29EE7 | A0A072J517 | A0A013IEY9 | UPI0005B1DD9B |
| UPI000598D943 | UPI0005F03F71 | UPI0006435FC4 | A0A0DIGPU1 | A0A010LP37 | A0A0D0P607 |
| UPI0005893785 | UPI0005CD8DCC | A0A0C2A864 | A0A0D1F105 | A0A013V1J9 | UPI0004937CC6 |
| A0A0F0QX40 | H7EDJ9 | C3K451 | X7NM08 | A0A011IN70 | UPI00059B6C6A |
| Y1GHZ4 | UPI0002BA9774 | UPI0003031244 | A6B4T3 | A0A011GFN4 | A0A0A5Q092 |
| A0A0J0JWN6 | A0A073TQR6 | UPI000376837D | A0A0F6M2K0 | A0A009I9W9 | UPI00006996A18 |
| A0A0J0RY26 | A0A0J8XHE7 | A0A023C475 | A0A0E2PRB3 | A0A062JC54 | UPI0005A7E00F |
| A0A0F1BFH2 | A0A0D8LLA3 | A0A0J6GRZ4 | Q87TM8 | A0A062T611 | X5HRY7 |
| UPI000668CF1D | A8ACT1 | F3K6V6 | A0A0F6LVP7 | A0A062IXJ9 | A0A0G3BY85 |
| A0A0J0NMD9 | UPI0003EF7A22 | E7PGN6 | Z2EEI2 | N9BR66 | UPI00051C6305 |
| UPI0006AA4E04 | UPI0004D811CA | F3EC88 | A0A0A3VAZ6 | UPI00036B0A84 | UPI0005B1FBE6 |
| A0A0F0VNG6 | A0A0I2AP98 | Q48QC4 | Z2EDP1 | UPI000426CED1 | A0A023E407 |
| V3CMI1 | UPI0002328C93 | E7NYU2 | UPI0004A2C7E5 | V4N4Z7 | A0A081LLX9 |
| A0A0J5K4Z7 | UPI000369897B | J2RG73 | A0A0A3V6V0 | UPI0002836BF4 | UPI0005AA429F |
| UPI0006AC63C4 | A0A089VYB3 | J2UNX5 | UPI000472ADBC | A0A0K0HLP9 | UPI0003603F0F |
| UPI00041ACFD5 | UPI000541FC4B | UPI0069F8C81 | Z2EJN6 | J5N8B5 | A0A0J1M7R1 |
| A0A0F2AQL9 | UPI000579035F | A0A0F0EFQ7 | UPI00041561ED | J6CRI5 | UPI0006489688 |
| A0A0F5B4Y8 | I2BE87 | W2DRJ6 | UPI00021A9FCC | UPI0003D82FE7 | K1J828 |
| A0A0J1RFK1 | UPI0004E1359A | A0A089YRC6 | UPI0001BAD8BD | Q9CLZ0 | UPI0005AAFC0D |
| A0A0J0RJ15 | A0A085GMM2 | A0A0G3GBQ2 | UPI0053C3D1D | J4SJC5 | A0A0A5NK04 |
| A0A066NY31 | UPI00039B2EBD | J3ICZ1 | UPI0005C160B8 | J6CUJ6 | UPI00051C9AF5 |
| A0A0J0LMR4 | UPI000540F32C | J2UE96 | UPI0004D7564A | UPI0002828EB6 | A4SHB5 |
| A0A0F1A8L1 | UPI00052BFF33 | J2U1B0 | UPI000541DCCF | UPI00025912D9 | R1GU16 |
| UPI00049A4378 | UPI0002C9F7CC | J0P5Y9 | A0A085T413 | UPI000256A08F | Q5YL02 |
| A0A0H3BNR1 | UPI0003FFEF4B | F3IWL2 | UPI0003591073 | UPI00061A7F96 | A0A0J5SCJ7 |
| UPI00036B51A5 | UPI0002CC6D1E | A0A0D0SPI8 | UPI00069CC245 | UPI0002F21178 | UPI00040E493E |
| A0A0F3ZKX7 | A0A0H3FM31 | Q88BA4 | UPI00069D2456 | UPI0005615OA9 | UPI00026C7DD5 |
| A0A064DDL2 | UPI0004E3009B | A0A0F0F2C4 | UPI0004E3009B | F2MWQ4 | UPI00034AEF0E |
| UPI0005EEABA8 | UPI0002A4658A | UPI0006425E29 | UPI000682B11B | H7EWN0 | K4KNG9 |
| A0A0F1B160 | UPI0006684CD5 | UPI00048CEACE | UPI0004D918FF | UPI00046225F6 | UPI0005916203 |
| A0A0J1VF42 | UPI0002CCBD72 | F2K6U9 | UPI00064977DD | A0A028VHX2 | Q1MXX3 |
| A0A0J1RH04 | A0A0JUQT3 | I4N769 | UPI0001A928F | A0A0F3G1C6 | R1J2K6 |
| UPI0003BDCA59 | Q8XAT6 | UPI00054B3B22 | A0A0H6V1C5 | A0A0F3G1H1 | A0A0F5ZTG2 |
| UPI0005F8E6D5 | R6U5R3 | UPI00034B3DE4 | UPI00041CDED6 | A0A0D7EEU5 | UPI0002D73F2D |
| A0A0F3YH15 | A0A0F6GUR2 | UPI00054BF274 | M5NBE2 | A0A0I9SHZ4 | UPI0002E30D8F |
| V3DS68 | M8JSN4 | UPI00035C9B5D | UPI0005A612B3 | I4CY47 | D0I4E4 |
| UPI00067FBCBD | UPI0005EF606F | UPI000466DC2D | A0A067BE00 | A0A098FXA5 | UPI0004826336 |
| A0A0H0BBR0 | C3SKS7 | A0A031J819 | A0A0E2KH36 | F8H8H9 | UPI0005F7AFD8 |
| W7NPC9 | H5E8V7 | A0A0E2JIS7 | A0A011RY08 | L0GNC3 | A1SAR2 |
| UPI000237CAE2 | A0A073G4J2 | F3DX19 | UPI000218FD46 | A0A0B5C9B4 | A0A0F7M0Q2 |
| A0A0H0B833 | E9TMZ3 | S6WCS6 | A0A0H6I7N5 | UPI0004752163 | A0A067A0E9 |
| X5GBQ8 | M9HCU8 | UPI00069D83B7 | UPI0004DF1506 | F6AK49 | UPI00056F77EF |
| UPI000480BC4B | N2GRQ0 | F3EY12 | UPI00040CF721 | S6JQB6 | UPI00046459AD |
| UPI0003BF53EE | V8FGU6 | A0A024EDQ4 | UPI0003A5CF66 | UPI0002C171C1 | UPI0005A6CCD1 | R8ASG1 |
| UPI00043B1758 | W1G9Y1 | UPI0003A5CF66 | S5IY40 | V4QKI1 | UPI00057A6730 |
| UPI0003288250 | D8E9I5 | UPI000473172F | A0A0H6RK46 | V4PVZ8 | UPI000647EC3B |
| A0A0F4B9X9 | A0A080FRF1 | UPI0004837A57 | UPI0003FCEE4D | A4XNW1 | X6QAT8 |
| UPI0005EA547A | A0A074HNG7 | A0A0D9A8H9 | D0HB12 | UPI0005B96553 | A0A0E2Q742 |
| A0A0E1J7G4 | D6IG13 | M5R504 | A0A0H6U223 | A0A0D0KWI3 | UPI00065DE691 |

TABLE 5-continued

List of 3137 unique non-redundant helicases that have 50% sequence identity and 80% overlap with E. coli Rep. (Uniref50_P09980 cluster, citable UniProtKB and UniParc accession numbers are shown).

| | | | | | | |
|---|---|---|---|---|---|---|
| A9MJ31 | N3JTF2 | J3FAA8 | A0A0H5V3D7 | UPI0004CF668E | UPI00029BA482 | |
| V1K9F5 | J7R7U6 | A0A0J6G1D6 | A0A0H6XKF0 | UPI00027874F3 | D1P301 | |
| A0A0H3CTF5 | A0A0A8UGH0 | UPI00069EC1FC | UPI0003F7284F | UPI000483B47F | W3YJP2 | |
| A0A0J0I6K1 | A0A026UZB6 | A0A031GCP2 | F3LEK2 | UPI00066DB41B | B6XD39 | |
| A0A0H0C2Z0 | M8L4U0 | U1SSX9 | M4RF91 | M2TXC8 | K8WDI3 | |
| A0A0J0K9E8 | F8XAU8 | V7E1I4 | UPI000290E44C | UPI000646559F | D4C425 | |
| A0A0F0TB35 | I0VX84 | A0A0A6DIW0 | K6YD96 | A0A0H3YQ39 | K8WMJ7 | |
| UPI0003546D46 | M9GR01 | UPI0006465369 | UPI0005254C58 | UPI0006274DB0 | B2Q4K1 | |
| A0A090ULL0 | A0A028CB68 | UPI000640671F | C7R609 | A0A0A1YQ26 | I0DV03 | |
| V2HH02 | F4W233 | A0A077FGC9 | UPI000483BB31 | U2Z897 | K8WW49 | |
| A0A0E2JMN1 | A0A073FPG7 | A0A077LKD4 | UPI00041E0643 | UPI00048929DA | A0A099DD54 | |
| A0A0J0LZB7 | V0XEM3 | F3DEB8 | S6BLM3 | UPI0004CF0F54 | UPI0005B3D15C | |
| A0A0J0TKA0 | H5J8G9 | A0A0F4TWU8 | A0A0H2QE7 | A0A023WXA7 | A0A0A7ED48 | |
| A0A0J0CC39 | D8ERM8 | W6VH72 | A0A0H4HX48 | W6QPC3 | U1M4M6 | |
| W0BFN6 | A0A079Y2M7 | I4K9P3 | A0A0H4HA84 | A0A087F8M6 | UPI0005EAE7B0 | |
| G8LKX8 | L4UZJ8 | UPI00069DE63B | A0A0H4GYY0 | A0A061CNF1 | UPI0003813008 | |
| UPI0005CF9B3D | T6GRI5 | G8Q5Z2 | Q7VNG5 | U3HS13 | N6X102 | |
| UPI000665E6B2 | H5IRB6 | S6I6M5 | A0A0H4GVY1 | UPI000306C138 | UPI0003A42C04 | |
| A0A023V5X5 | A0A027YRN5 | A0A0F4XJX5 | UPI000364DF85 | F4DXY8 | W0TMS6 | |
| W1FX72 | G2AN10 | UPI0006257434 | UPI000312E129 | A4VGV2 | U7HXH2 | |
| A0A0G2MPB1 | L3PUX5 | F3IN68 | U3B5Z6 | U2B4P9 | K0CFZ9 | |
| A0A0H2WUK6 | V0Z4M2 | A0A0D0N8H7 | UPI000429C1C2 | U1T3I8 | A0A071LPA7 | |
| UPI0005ED7CE9 | L3C1G4 | S6RD61 | V5HP10 | Q088M5 | UPI00041A839D | |
| UPI0005749AE1 | M2P3K5 | S6T6P7 | A0A0B8QVA0 | K6YBB4 | A0A078MHY5 | |
| W8XNK6 | M8PIH5 | UPI0003770316 | UPI0002DF401C | UPI0003B45ED8 | UPI0005CA5673 | |
| G2S5J6 | I2UBA9 | A0A083UT61 | L0DT46 | C2LKQ6 | A0A031MHW5 | |
| A0A0J4QGK6 | A0A026RV20 | S2EZ50 | UPI0005099D99 | B4F1V1 | UPI00048184EA | |
| A0A060UXG1 | A0A0H3JJN7 | U7DPS2 | UPI00041EBC8E | V6MEX9 | UPI000480EBFA | |
| V1SVN5 | A0A0G3JMJ8 | J2XUG2 | UPI0003B66AF2 | UPI00040DD930 | A0A0A7RZK1 | |
| A0A0C9GL09 | A0A027TGI5 | A0A0E1ED74 | E6Q994 | A0A094VIT6 | UPI0006656150 | |
| A0A0C9GYL4 | D3QX71 | I2BSP5 | B7J5H5 | A0A0G4QET2 | F9H319 | |
| Q8Z385 | A0A023Z524 | I4LAD3 | B5EKY0 | C0AS08 | UPI0002E7B4B9 | |
| UPI000500230C | A0A0H3EP47 | A0A059KWW4 | G0JPR1 | A0A0J1FDF2 | A0A0E1WIG4 | |
| A0A0J1UWJ0 | L9HY53 | W6V2S0 | A0A060USE4 | A0A0G4QJK0 | UPI0002DA963E | |
| A0A0E2M7J9 | A0A0H3PQH4 | UPI00037298BE | A0A099KS81 | UPI000536EEA0 | UPI000045EA18 | |
| A0A0J4NUP9 | A0A027ZJD8 | J2SK90 | Q48A47 | UPI00066713AB | UPI0005BEB3B1 | |
| M7P8Y2 | A0A0F6FEN5 | UPI00062A28D4 | UPI000369C377 | UPI00053159BF | UPI0005BEAFC8 | |
| V3KJ47 | A0A0F6CB93 | A0A0J6LHZ7 | A0A099L585 | UPI0005FB88C6 | UPI00068166C9 | |
| X0NMP3 | A0A028E3B5 | A0A0J6IZ62 | UPI00053E216F | UPI000538E59F | UPI00006B0F31D | |
| A0A0J0MEC2 | A0A025G7Y1 | UPI00054BC3BF | A6VEA1 | J7TSU4 | A0A0E1SM32 | |
| UPI0002B9ECA4 | K4VYE7 | F3HE08 | A0A086BUA3 | A0A0A2R681 | A4N6A7 | |
| UPI0003A99D9E | A0A025C056 | UPI0004855F80 | UPI0000D7267E | A0A0H2RF05 | UPI0006699B6B | |
| UPI0003BD7E08 | B6I4B4 | A0A0E2UZ31 | UPI0004CEE864 | UPI000665888E | UPI000682D126 | |
| UPI00017C01C2 | A0A0H4S0M7 | UPI0004B486C5 | UPI0005C9EB61 | UPI0004684BD5 | UPI0001A3F561 | |
| A0A083YZC2 | W8ZQB1 | UPI000467E321 | UPI00059FF9E6 | M7CFP7 | UPI0005AEEC55 | |
| UPI000633E857 | C8UJG0 | A0A0D9APL4 | L8MSN6 | UPI000509F66A | UPI0001545AFF | |
| A0A0H0B767 | A0A0E1ZWP5 | A0A0B1Z6A5 | UPI00048D30BD | UPI0004148097 | UPI00062D80BD | |
| UPI00049F603B | A0A0A0F921 | A0A0C2I7D7 | UPI0005BD2953 | A0A0H2QVE0 | F9GRY7 | |
| A0A0J5L5Y8 | F4VLA2 | K2SWK1 | UPI0005CFE450 | UPI00062C8767 | A4N0M7 | |
| UPI0004A7224E | UPI0005CCA9B7 | S6RKJ9 | UPI00053E8C86 | UPI0004632748 | UPI000667602A | |
| UPI0002E3DC58 | UPI0005CF3F54 | K2TIC3 | UPI00004633730 | A0A076LNV0 | I3DT46 | |
| V2LMA2 | A0A0F6VR07 | F3GZK6 | W5IS76 | A0A034T5A5 | E7A6L1 | |
| UPI0006AC7A4B | A7MQI4 | A0A0E3K5L5 | UPI00053D2EE8 | A0A0H4Y5C6 | UPI00049A786F | |
| A0A0G2MI6 | UPI0003EF9AA0 | A0A0D5XSI5 | UPI000281A7AB | D0Z969 | A0A0D0HPX5 | |
| A0A0H0DGX5 | UPI0004A0972A | F3GAT3 | A0A024HPG4 | A0A0H3DLQ4 | F9H118 | |
| A0A0J0STY6 | V4B7H4 | U6ZWQ4 | A0A0H3QKK2 | A0A0E0YV25 | UPI00014FD51C | |
| A0A0J0B4N3 | W1F1B8 | A0A0D0N1N0 | A0A081YDT2 | C5BBB0 | UPI000039A987 | |
| A0A0H0DLE1 | UPI0002FA2529 | UPI000291716A | UPI00021202D8 | A0A0J7JPC0 | UPI0006667D95 | |
| A0A0J0TZE8 | UPI00066D0413 | UPI00048B1910 | UPI0002819173 | M0QBY6 | UPI0005AF4057 | |
| A0A0J0DI84 | UPI0002CB68C1 | E0WUJ5 | UPI00053ECB14 | D4F9S6 | UPI0006658AEE | |
| A0A0J0M6U1 | A0A0A1R5L6 | UPI000586ABB4 | UPI0005D3900B | UPI0002FC6C68 | UPI00062DA742 | |
| V7UEQ3 | UPI0002CBCFF5 | UPI00058FF140 | UPI0004CE44FE | UPI0002EC2B1F | UPI00066825F9 | |
| A0A0J6MH73 | UPI0002CAB9DA | A0A086D7H2 | A0A071KY05 | A0A0F7NRS6 | UPI00062DA3B5 | |
| A0A089GCS8 | UPI0002CA9661 | Q1QSL3 | W1MWV7 | I1YH83 | T2BJ41 | |
| UPI00057D22D2 | A0A0J2DYF8 | UPI0006507055 | Z2DC34 | A0A0C9NZX6 | UPI00045A627C | |
| A0A0J0DPX9 | V0VJI0 | K6ZDC1 | Q9HTQ8 | UPI0004814447 | A0A0D6FR93 | |
| UPI0004DB41FA | L2X5H3 | G4QEW3 | A0A0H2ZJC9 | UPI000485F550 | A5UHE1 | |
| UPI000647BC86 | T5TGV8 | A0A094ITY3 | V6ANV3 | UPI000481ED5E | UPI0001F36303 | |
| UPI000464DFFA | A0A0J3V897 | A0A078KWA8 | A0A0E1B1Y8 | UPI0005C7E8F6 | UPI00066E1D5B | |
| A0A0J0JNC2 | U9YXY7 | R9PLC1 | UPI00066A1682 | UPI00048C3840 | A4P0W5 | |
| A0A0F1RDS8 | X7NZP7 | F9U5G0 | UPI00053CF5E1 | G8UU65 | E1W2I7 | |
| V3ICZ9 | S0VJS5 | UPI0004214388 | UPI000483B998 | Q5ZRR4 | UPI000066D46C5 | |
| UPI0002ED4344 | UPI000553AB9C | A0A085HDC4 | UPI000453754D | Q5WSZ4 | A0A0E3LZ36 | |
| UPI0002BAF5C3 | UPI00038FBA14 | UPI0004899DBF | UPI00053E9238 | A0A0C9MYI5 | UPI00066C24A1 | |
| A0A0F0RUW6 | UPI00069AF41C | A0A0G3CX27 | UPI00044B92FC | I7HM78 | UPI00066D30E4 | |
| A0A0J5X4F1 | E9XUF9 | U2EN75 | UPI0004F243CA | UPI00048A337F | UPI0004763AF3 | |
| A0A0J6MA72 | UPI000377C134 | F7RTH7 | UPI000281A2C7 | UPI0001E3CB67 | UPI00066D6A55 | |

TABLE 5-continued

List of 3137 unique non-redundant helicases that have 50% sequence identity and 80% overlap with
E. coli Rep. (Uniref50_P09980 cluster, citable UniProtKB and UniParc accession numbers are shown).

| | | | | | |
|---|---|---|---|---|---|
| A0A0J0EMG6 | UPI0006144C0E | UPI000560CC8C | UPI000025BA256 | UPI0005A659E8 | A0A0H3PBZ3 |
| A0A0F0Y3A8 | UPI0002C95440 | A9L5H2 | UPI0005B80B94 | UPI000489B225 | UPI0006EEC6E |
| V2L1P6 | UPI0002A387C3 | A3D9R5 | M4X2N2 | D5TAM2 | F0EQH8 |
| A0A038D4Q8 | UPI00028D7E4A | B8E891 | UPI000464F24C | A0A098GC77 | F9GLZ1 |
| V2AL75 | UPI0003EF002B | Q8E9F8 | UPI0005DFB5E | A0A0E3V4J7 | UPI00068332D3 |
| UPI0006AC6CB6 | UPI000675F6B9 | V1DQ01 | A0A0H3RZC1 | A0A0E2Z1G0 | P44804 |
| S5MWY3 | UPI0002CB1048 | B0TJQ2 | UPI00053F27B9 | Q3J9N2 | A0A0E1WD80 |
| UPI0005E6338A | UPI000666D01A | A0A073KJP1 | UPI000580BD50 | UPI0004E88D84 | D1NF27 |
| A0A0G3TQ60 | UPI0003917D4F | A8GZF1 | UPI0003B96CAA | D8K6Y2 | UPI00066786CF |
| V5KMV0 | M8S4Q2 | A0KS48 | UPI000627ABF2 | H8GKB8 | UPI0005BEB07A |
| A0A0H3TAW8 | A0A0F6TYB8 | Q0HQH5 | S6AK57 | UPI00045E6F7C | UPI00062D93E5 |
| A0A0K0IDI8 | UPI000667500F | UPI00005E53DE | U3HFM7 | G4E537 | H1LQ71 |
| UPI0006678805 | A0A0G9GD89 | UPI00048E027C | A0A0D6T1C3 | UPI000592722C | Q4QMR8 |
| UPI0005CFE58C | UPI0001E172D8 | UPI00057AE72B | A0A077K6N5 | A0A0D8CVB0 | F2BZJ0 |
| V3R0S0 | UPI0005A5D84A | E6XQS6 | UPI00036968F6 | UPI0037B7540 | D1NGE3 |
| UPI000667F205 | K4WL59 | UPI00048F743D | W9UTB0 | UPI0005A79D1F | D1NDK2 |
| UPI0003BCBEBD | UPI00057BF7EA | A4YBH4 | UPI0004074F9F | UPI00048C3DFE | UPI0005891512 |
| F5S3F4 | A0A0J4KMU3 | B8CHT8 | UPI00037EAC87 | I3D5Z6 | E1XAV0 |
| A0A089QXV4 | UPI0004D4223E | UPI0005CD4AEB | UPI0006868A78 | E4PK47 | I3BJY2 |
| UPI0005DE95D8 | UPI0002C9357C | Q12S77 | UPI000685365C | M7D8V7 | UPI0006ABC8FB |
| R0EH56 | A0A0A8KN31 | UPI00046EB07E | UPI0006853B62 | UPI00034BBD60 | UPI00066B7069 |
| A0A0A6H3D6 | B7L8B9 | UPI00015880E3 | UPI0006878394 | U7G1L2 | UPI00066AD24C |
| UPI00068B0F23 | A0A0E0Y664 | UPI000468006F | UPI000688C08A | U7NT63 | D3RTA9 |
| A0A0H3RA37 | A0A0D1BKY7 | G0ATX3 | UPI000687FD4C | A0A0J7J5V1 | UPI0005D3DD99 |
| A0A0G2NZC5 | E3PNW8 | UPI00005FDF28 | UPI00068620CA | R8AXS8 | A0A0D8PL98 |
| UPI000353D040 | N2IIK3 | I3Y6V4 | A0A081N6G5 | H8WDK4 | UPI0005314008 |
| UPI0005E5AEEC | S1HQ90 | E1VG66 | F3KEE2 | U7H536 | A0A0A2Y273 |
| A0A0J0WRS8 | K5BLY1 | M7PDW2 | UPI0005F86AB0 | U7NXR9 | A0A0A2XH45 |
| UPI00069B3A9E | T9CGI0 | A0A081N9R3 | W0SBD9 | A1TXU4 | A0A0A2YTN3 |
| A0A0G4BD19 | A0A0F1KJV2 | A6VM58 | UPI0003B7AAB8 | A0A072MY82 | UPI000530E664 |
| UPI0005C61441 | A0A0F6K2V6 | B8GLW7 | UPI000409CD7B | UPI00069EBA57 | UPI0005314059 |
| UPI0005F19921 | UPI0002A2036B | UPI000570B5D1 | UPI000410D42B | G6YNL9 | UPI0005316FE |
| A0A0J6D7T8 | UPI0003915B14 | UPI0005278D4D | W0HH80 | UPI00031A8E93 | A0A0A3A494 |
| V2AVQ0 | A0A0G9QFI5 | A8G0X8 | Q2NQB0 | UPI0005230701 | A0A0A3A7G2 |
| V1GTV0 | A0A0J1ZW66 | UPI00048BE683 | W0HNJ1 | F4AHB5 | U1I2Y4 |
| UPI0003FA6617 | V2S178 | A3Q9M9 | UPI0005609D73 | Q15ZT6 | F4HF21 |
| UPI000665C816 | N4NBQ8 | B1KQB1 | UPI0005C9970E | K6XTE6 | UPI0005310D73 |
| M4LS14 | N4NKF8 | A0A0C3QZI7 | UPI0003FDF7C7 | K7A404 | A0A0A2XIV9 |
| A0A0J5MXA1 | N4NZ19 | UPI00052F1E8D | UPI000484C7F7 | K6YMY3 | A0A0A2ZUW6 |
| UPI00051391FD | A0A080EIA1 | UPI0004908F35 | A6EZW9 | A1K1U9 | A0A0A3AZE6 |
| A0A0A5R3K5 | L2VFP6 | Q21PD1 | UPI00058F11A8 | G2FGY2 | A0A0A2Y9K8 |
| A0A0J0QVL7 | M9ER59 | O51889 | A0A0F9NYG7 | G2DBK1 | UPI0005313184 |
| A0A0J0R4I6 | U9ZQ00 | UPI00034A05A0 | Q478X4 | UPI000360CFDB | UPI000530C37C |
| A0A0F1HGA3 | N3NAA8 | G4SXF2 | Q2BRL8 | W0BEM2 | UPI00053223C9 |
| UPI0003298127 | M9JK23 | UPI0004E1B20E | UPI0004E83861 | W2V1F8 | A0A0F3KHK4 |
| A0A0H0A7S1 | N2JXH2 | A0A084T7P6 | UPI0004A193CB | A3JE71 | UPI0004272D7B |
| Q9L6S1 | A0A080EPX3 | A6D9P6 | U4SR36 | A0A0H4I8W3 | Q5P4B6 |
| A0A0D6TML9 | B7NF83 | A0A090S7S9 | U4SES2 | UPI0037E8B5D | UPI0006A9A723 |
| A0A0E8MKU3 | A0A0H2VE70 | A0A090SBH7 | U4S459 | M1FGB5 | UPI000411120A |
| V1L7R7 | UPI0002CACCD9 | G3IVH2 | UPI0002CBFAC9 | UPI000572A7F6 | UPI0004221DBE |
| A0A0J8M094 | N2RLH9 | UPI0004DF8545 | UPI0003AC4DB6 | UPI0004744F39 | UPI000485D7F1 |
| S4IGJ2 | A0A0J1LII8 | UPI00047F1C5C | UPI0004ED825E | A0A0F0DKQ4 | UPI00045EA9DE |
| S4J21 | UPI0003DE3024 | UPI0001ECFED8 | U4RRC2 | V9HKH3 | B9YZ61 |
| V1PEP5 | A0A0A5RMD0 | P57654 | A0A063CT47 | C4L8M5 | G2J035 |
| A0A0J8MRJ4 | A0A085ITL8 | UPI0004B2EA54 | U4RTG0 | UPI000467E424 | UPI0004844892 |
| A0A0J8I253 | A0A038CLT3 | A9CX24 | A0A0E1RML1 | N6XTH8 | L8D9A1 |
| T2Q8L1 | UPI000699D02C | D4ZCT1 | B8F834 | N6X5A1 | UPI0005DDA656 |
| S4I960 | UPI00053015A9 | UPI0006860AC7 | A0A084EXM6 | S9ZLZ2 | UPI0002DE6662 |
| V7VTQ5 | UPI0006A5F9C7 | A0A080UY52 | U4SEE3 | N6YIH6 | Q8D1K7 |
| V1U623 | UPI0002C9392A | L7Z9H4 | UPI00049FFDBE | A0A0J8Q929 | UPI000267BACB |
| A0A0J8MLX1 | A0A090V5M6 | A8G826 | UPI0004DFBD5A | N6YW13 | UPI0002679FF8 |
| A0A0J8KIG6 | UPI0005F02BB9 | U2LS81 | A0A0F5EXR4 | C4ZMK0 | UPI00036F034D |
| A0A0J8LPE0 | A0A0G2XKH3 | UPI00020E94C4 | A0A0F5EPE0 | N6XY51 | A0A014M0T5 |
| A0A0J8JI45 | I6FIC7 | UPI0002DABF6B | S6EML5 | A0A0C3J2Q5 | A0A0B6P3H3 |
| A0A0J8NNW4 | E7SHA3 | L0MCV8 | UPI000376F3D1 | UPI00056F25D5 | A0A0E8XKA8 |
| A0A0J8M386 | I6DJI8 | A0A0G8B441 | UPI0004921C45 | E1SPI9 | A0A0E1NWJ3 |
| S4KQN0 | B2TU14 | UPI0002A42D68 | UPI00036D6D23 | UPI0003B58CFA | A0A0H3B897 |
| A0A0J8HDW7 | E7TCP3 | UPI0006652A04 | UPI0006737FF4 | Q65VJ0 | A0A0H3QMK7 |
| S4JDD8 | Q31UK7 | U2L789 | A0A0F9VQX3 | I3DJM6 | Q66G21 |
| A0A0J8M6F4 | UPI0002C9AB91 | UPI00061B5F40 | A0A094MWI0 | UPI0005CAE678 | Q0WAE0 |
| V2N1K8 | R9VPF2 | UPI000325C91D | A0A0C1MVM0 | UPI00069EE2BB | A0A0H2YE35 |
| S4K7P0 | K8CWZ5 | UPI0006688668 | U1LW91 | UPI00069E268B | A0A0E8MJ70 |
| A0A0J8LWR5 | UPI0002C99AA5 | A0A0J5CK09 | A0A0F4QKC2 | UPI00069D7318 | A0A088KV63 |
| A0A0J8HEC7 | UPI00038FB95B | S5EBF4 | V4JJ09 | UPI0003FDFDBC | A0A0B6FKI9 |
| A0A0J8JAK5 | UPI0002C96518 | A0A069CNT5 | A0A0F6A4M8 | A0A099KBQ4 | A0A0H5LYI6 |
| A0A0H5PMJ7 | W9BJ58 | A0A087L2V7 | UPI0006270414 | UPI0003FBA996 | UPI0005DF0BEB |
| V2NGI2 | A0A0I2BS34 | A0A086G6L5 | UPI0006271440 | UPI00048E7C37 | A0A0H5H7D3 |

TABLE 5-continued

List of 3137 unique non-redundant helicases that have 50% sequence identity and 80% overlap with
E. coli Rep. (Uniref50_P09980 cluster, citable UniProtKB and UniParc accession numbers are shown).

| | | | | | |
|---|---|---|---|---|---|
| V1SGL7 | W6J7C4 | W0L9M1 | UPI0003618E19 | UPI000482708E | UPI0006827E21 |
| X5MWS2 | UPI000500BF0E | UPI000066770B0 | UPI0004BB1652 | UPI00051D9F62 | A0A0H5JCZ5 |
| T2PQT7 | K8BQX4 | D4E004 | I3BQA3 | A0A0E9BPQ7 | A0A0H3NX30 |
| A0A0J8KVX1 | UPI0002CBEEC2 | UPI0006615922 | H5TCX1 | UPI000495F3A1 | UPI00067863B0 |
| A0A021WMC9 | A0A0J4V9J3 | UPI000408D809 | A0A0B7J8T9 | D4GGK8 | A0A0F6ZK05 |
| A0A0J8J9B6 | A0A0B7GDH2 | A0A0F7HAB5 | A0A0C5WV68 | A0A0H3L1U7 | A0A0H5ETP1 |
| V1I8P9 | Z5CRA3 | A0A0G9N4S7 | UPI0005CBA06D | UPI00047515EA | W0UFJ9 |
| S4LIK5 | B5XYZ5 | A0A0F6KPT4 | D0Z154 | A0A0E9B357 | UPI0005E9ED67 |
| V2A692 | D3RHB6 | A0A0J8P0E6 | A0A0D8MPB6 | A0A0E9BHY8 | UPI0005DD7BF8 |
| A0A0J8L0F3 | UPI0004D7628C | S4YDU2 | F2PBR6 | UPI000468BFB9 | UPI0005E79D67 |
| V1MB85 | UPI0003A3F66F | A0A0J1YD25 | A0A066RXJ4 | A0A0A1B4E0 | C4U266 |
| B3YF36 | A0A0J4SW69 | A0A0J5CHL9 | UPI000307D228 | A0A0A3YME8 | UPI0005DB455D |
| S5ILC5 | UPI000616F32D | UPI00046870F9 | UPI00040F27C9 | U2MK51 | UPI0003029766 |
| A0A098GZB1 | UPI0002CA634B | A0A084A575 | Q2C483 | E0M1J4 | A0A0H5IPV3 |
| V1XST3 | UPI00061449AA | S0A849 | A0A0D8SB06 | A0A0F5XV05 | A1JI64 |
| V8ME39 | UPI0006A97B14 | UPI00048AA12D | A0A0D8LLV6 | UPI00036D7981 | A0A0E1NPM1 |
| V2JQQ7 | UPI0005762BA1 | UPI000487A67F | Q1ZK16 | UPI00034BF070 | W8U8V7 |
| A0A0H3S2U0 | I6FYC6 | D3HNV7 | A0A0D8LUA2 | UPI0004E1A398 | UPI0005E99F5C |
| X2KI94 | A0A0J8VI05 | C6C798 | A0A0J1GP27 | UPI000508FC34 | UPI0005E00E96 |
| A0A0H3SKK5 | UPI000699B795 | UPI0005615E14 | A0A090RJP1 | A0A0B1RCL6 | A0A0B6HTA5 |
| B5EZ38 | C8TL39 | UPI00040FFE96 | A0A0J1H812 | A0A0A6YFE9 | UPI0005DDB975 |
| A0A0H3ILF8 | K3PM43 | UPI0005684D6D | UPI0005D2DDB6 | A0A0D534D94B | UPI000173969B |
| A0A023N7J2 | A0A026HND2 | UPI00037540FD | UPI0005E822AD | A0A0D8YE92 | UPI0005E5EB23 |
| V2P0B4 | B1ERC7 | A0A0J8YX51 | UPI0005E9034E | A0A059IDE0 | A0A0E8MKS9 |
| A0A0H3NHT9 | S0TTI5 | UPI0005E8F2FE | A0A0D8QVE1 | U1TNM8 | A0A0H5NCP1 |
| A0A0H4V1S8 | UPI0005309AD3 | Q605Y2 | A0A0J1H2I7 | E1SK66 | A0A0B6HCA7 |
| V7RZ28 | K8BE03 | UPI000308B214 | A0A0B9GYU2 | J3D9Z5 | A0A0H5MV89 |
| M7S3Q8 | UPI00044CED1F | UPI000413FA42 | L8J7D2 | UPI0002A6B5C9 | A0A0H5PMI9 |
| V1GIN0 | K6KFS6 | UPI00037FCD36 | UPI0005959C45 | U3TSP9 | A0A0B6LTD8 |
| S5HF97 | UPI0006662A0A | A0A068Z3I4 | UPI000509EA27 | A0A0F3LWH1 | C4UBW2 |
| V0GNY3 | UPI000448B406 | E9CNV6 | N8QMA4 | UPI0005C52466 | UPI0005E9D7FF |
| A0A0F0ITA3 | UPI0004207793 | A0A068RDD4 | N9Q5H1 | UPI00048B685F | A0A0H5MA43 |
| A0A0E1CUB8 | UPI0004468690 | UPI00039B0A85 | S3TBN2 | UPI00069BBC9C | A0A0H4MX63 |
| A0A0F7JC30 | A0A0G3PTV9 | A4BKH1 | N9PM38 | E6WHD8 | UPI0005E84131 |
| G4C8N2 | A0A0J8ZB76 | UPI0002E7F8E9 | N9RHD1 | UPI00050F5F1D | C4T540 |
| A0A0D5WN88 | A0A0J9AH95 | UPI00036F75F9 | A0A009KDR6 | A0A0F5FBT2 | UPI0005EA618B |
| A0A0F2ZS42 | J5XNR1 | UPI0004772558 | N9MFP0 | UPI00025848BE | UPI0005E2712E |
| V5ZRF3 | A0A0E0WT30 | D3SDE5 | A0A022IP23 | UPI0005358D4C | A7FD44 |
| V2D3X3 | UPI00066507BD | UPI000363C2C3 | K9AX41 | UPI00067631F8 | C4SH32 |
| B5Q5L3 | UPI000665B1C4 | UPI000381348D | A0A009KTD8 | UPI0005342DB0 | UPI0005E88594 |
| V7IN29 | UPI000664F825 | UPI00036A352B | N8RGJ8 | A0A0A3YQZ0 | C4S2J8 |
| E8XIM3 | X4BC54 | UPI0003638A7F | V2TJN5 | J2UWK2 | UPI0005E15072 |
| A0A0F6B977 | UPI000517D3E6 | UPI00036CFC7 | V2UWT0 | UPI000066187B2 | UPI0005DBB3AC |
| G5QS67 | A0A0I0Y9Y8 | UPI000036636AC | N9QAE1 | H3RIT7 | W8G789 |
| G5LVZ4 | A0A070TA81 | UPI0003689D3E | N9KD21 | D4HUI5 | UPI0005E9DE69 |
| UPI00067FCA22 | F3VD48 | UPI00035E83C6 | N9TJB8 | E5B0I1 | UPI0005E6D02E |
| G5PV49 | H4V842 | UPI00036EBDFE | N9RBQ9 | A0A0J8YTF5 | A0A0B6GH85 |
| G5RMY1 | K8ABZ8 | UPI00036CB07E | N8XKN2 | B2VG71 | UPI0005E21E25 |
| G5SIZ2 | V5U423 | UPI000371CE96 | N9MQT1 | UPI0002CAE332 | C4ULT0 |
| X3X6G6 | A0A085HAK1 | UPI00037E26A7 | N9N9M9 | A0A0A0ZCV1 | A0A085U6D1 |
| UPI0003063B27 | H5A4A8 | UPI000003719672 | UPI000570AC25 | UPI00048B3568 | UPI0005E5333BA |
| G5PBC2 | F5N8S8 | UPI00056FCF90 | UPI0005C62CED | Q6LVY9 | UPI0005E682AA |
| G5QW51 | A0A0J9AK28 | UPI00037734BC2 | N8VTA9 | Q1YVV5 | UPI0005E03B74 |
| UPI0005E961AF | UPI00067DF499 | UPI0003714E69 | N8VZT9 | UPI00062F612F | C4SRN3 |
| G5MQG3 | UPI0005CB2CD4 | UPI000422ADAE | N9TDU3 | A0A034U1R0 | UPI0005E51855 |
| UPI0005F2CBD5 | X4JC12 | A0A0G3FYM1 | N8V910 | UPI00030424F2 | UPI0005788705 |
| W1XLV9 | G5P130 | UPI00035DF508 | N8UMY4 | U5A599 | UPI00046D0E5D |
| A0A0J0N6G9 | UPI0003BCE0F3 | UPI0003653619 | N8U6B7 | UPI0002F53240 | M4R9M0 |
| V2IST2 | L0H0T7 | UPI00035F46DD | R9ATC8 | UPI0003081AE5 | UPI000046D66BE |
| A0A0J8F6X7 | UPI00062107C5 | UPI00037A10E5 | A0A0B0KKN3 | UPI0002E72691 | W0R997 |
| V1SFT8 | A0A0K0HP61 | UPI00035F39C1 | S7WVT1 | B7VH95 | A0A094IJP1 |
| A0A0K0HFU2 | A0A097QXR9 | UPI000381010F | N9KJH2 | UPI0005F9EDF7 | H8Z171 |
| UPI0005AB2AE4 | A0A0B8ZV63 | UPI000368288B | N9SJA9 | UPI00063A1E73 | C9R7F6 |
| UPI00062081F59 | UPI00005837FE4 | UPI00036D136F | N8W759 | A0A0C1NZP7 | E6KV30 |
| A0A0J5KVY8 | G9Y0Y6 | UPI00037F35BB | N8RKD0 | UPI00064760CF | UPI0005194C73 |
| UPI00029C3FF8 | A0A0C5VQS4 | UPI00035EC95C | V5C2I3 | A0A0F4NTM0 | U1S9B3 |
| A0A0J1VMC9 | W1FXH4 | UPI000367CCE4 | UPI00061832D7 | A0A0A5HSY9 | UPI000406D49B |
| D2ZMA5 | A0A085GZB9 | UPI000423C045 | A0A061JWL5 | A0A0A6T9A9 | UPI000060A603 |
| UPI0003A1A991 | UPI00062253DC | UPI000373D30C | UPI00036CBF04 | UPI0005E2F450 | G4A8W6 |
| D7XM77 | UPI0003A59E18 | UPI00036243F4 | W8QTS8 | F9RNX1 | G3Z8Y9 |
| UPI0002677FD2 | C9P8Z5 | UPI00037D0EF9 | A0A078LYT9 | A0A0F4NNJ4 | I1XRY3 |
| D4BE16 | F2JTM7 | UPI00037114DA | A0A099RR43 | E8LUB9 | UPI0006831C68 |
| UPI0005794143 | A4C7W3 | B5FCU9 | A0A0D9ATR1 | UPI0002E710F1 | G4AZ10 |
| UPI000260B9F8 | UPI00039F0D67 | Q5E1T0 | I4JQR3 | UPI00031D8F80 | L8UHA2 |
| UPI00028307CF | UPI0002558A91 | B6EP51 | I7A9J8 | F7YIE8 | UPI00067CF184 |
| UPI0006660AB8 | UPI0005B86EE4 | UPI000247865A | K5XG83 | A0A066UM26 | UPI0006815E34 |
| A0A0E0VC55 | A0A098G8R1 | A0A090IP02 | A0A0A1GK07 | F9S363 | H0KC96 |

TABLE 5-continued

List of 3137 unique non-redundant helicases that have 50% sequence identity and 80% overlap with
E. coli Rep. (Uniref50_P09980 cluster, citable UniProtKB and UniParc accession numbers are shown).

| | | | | | |
|---|---|---|---|---|---|
| T8Z104 | UPI000326FBA0 | T2L6T4 | UPI00040F147B | UPI0003102D21 | A0A0E1YSI3 |
| S0YAD1 | UPI00037E68F8 | L9UDC2 | UPI0004194356 | A0A099LPD8 | X2JQA6 |
| S0X3V2 | UPI00034D7EBF | UPI00037E36DB | UPI0003B39C7B | UPI0003167DE1 | UPI00067FF093 |
| S1DN83 | UPI00056CF143 | A0A0D7UZT0 | UPI0005BA4855 | UPI0002E0F676 | C6AQX1 |
| S0XCC9 | A0A0B8V8Y9 | A0A0F9VK34 | UPI0005B7EB79 | A0A0C2P7J1 | UPI0006A71057 |
| S1E4M9 | U4TCI2 | A0A0D5LWG2 | A0A0C1EK43 | A0A0C2JL07 | G4ABR6 |
| T9IPB3 | A0A0H4R6J4 | G4F9U9 | U1AEW3 | UPI00031E1DE0 | L8UIY4 |
| T6LBU7 | A0A0B8USV8 | A0A0B1PVT1 | UPI000617AEB5 | A0A0A5I590 | Q7MYL0 |
| S1GJ06 | UPI000368EE93 | H0J1C6 | UPI0006182BB7 | UPI0003043227 | A0A022PH42 |
| D8ADY5 | A0A095VW14 | UPI00048842D1 | Q7NQR9 | U3BS43 | W3VA31 |
| S0VUC6 | A0A0C5UZZ5 | UPI0002D5FF35 | A0A0J6LGT4 | UPI000571B2B4 | A0A0A0CQ83 |
| B7LU77 | W8FU49 | UPI000556BD4F | A0A0D8ZDY8 | A0A086WW56 | UPI0006203273 |
| A0A070K818 | M5DYB2 | A0A0C3I966 | UPI0004907BDE | F9T770 | A0A0F7LMM1 |
| A0A062XSU2 | UPI00046D03A5 | UPI0004843630 | C5BIA4 | UPI0005F11AED | UPI00055C23C6 |
| UPT0002C9B880 | R4YVB5 | F7SNI3 | UPI0003800078 | UPI000699D72A | A0A0J9EYL2 |
| UPI000651920D | H2G1G7 | UPI0004AB49AE | UPI000382D783 | UPI0005F118D8 | C7BQK5 |
| A0A0F3TFS9 | UPI000379F9FB | A0A060B1U5 | UPI0004227F3C | A5L7N9 | U7R5K0 |
| A0A0E2U8U7 | UPI0001EC45E8 | A0A0D6EF56 | UPI000035C7304 | UPI0001F55149 | A0A081RWC7 |
| C8TYS8 | C6XCN5 | G9EBD3 | UPI000369273A | U0FTU6 | UPI0058BF6A9 |
| A0A0J2E1P9 | UPI00035FCCBC | A0A0F4RA35 | W8KPW4 | UPI00030715AD | T0PH03 |
| UPI0005B2C8D4 | UPI00058D9CB0 | W1N5Q2 | D5C0J9 | UPI0006303856 | A0A085JM95 |
| UPI0002C95CB8 | A0A0A0BIG5 | UPI0004CE4C17 | A0A0A3AKX9 | E3BPB4 | A0A095VZP6 |
| A4WG32 | UPI0002DE5ECC | A0A081K8A4 | UPI0006A9F0F0 | E8MCD7 | UPI00046F3C99 |
| UPI0003420E0F | F5T1S3 | UPI000477FE94 | F7NR22 | Q7MQG8 | UPI0004A3375F |
| UPI00036F08F6 | A0A0F9NIL3 | A0A094JA28 | A0A066T3V5 | A0A087IWU5 | A0A0F9VYU9 |
| UPI0005C4EB5F | C0N7C2 | A0A090KED5 | A0A080LJV3 | UPI0006A98AC0 | I1XM63 |
| UPI0002C91779 | F6DAI6 | A6FE65 | X2GZR9 | UPI0006A98232 | I2JF40 |
| A0A078L9V2 | UPI0005C9F562 | UPI00030A12FE | A0A0J5P3I3 | UPI0002482DB8 | F9ZY05 |
| UPI000512B6F1 | W0DYM2 | UPI0002DF92C0 | A0A0F2P6J6 | F9REI7 | A0A0F5V836 |
| UPI0002CC209C | UPI000022C089B | UPI000464C875 | W7R0N4 | UPI0004F5E7D9 | S6GDK2 |
| A0A0D7LJA0 | UPI0006844205 | UPI000427CAB0 | UPI0004752339 | UPI00031835E8 | S6HCZ4 |
| A0A073VC48 | W7QF72 | B9CXM2 | UPI0004E147DD | UPI00031E4412 | I8U5K5 |
| X7I146 | UPI00058DEE31 | C5RZQ1 | UPI000479BC17 | A0A0H2MLA0 | H3ZE84 |
| X7HFY3 | UPI000289826B | UPI00035CAB1A | UPI00047B5018 | UPI0006195856 | J1YGP6 |
| A0A089Q204 | U7NY76 | UPI0003B481E4 | W9V341 | UPI0067F4562 | H2IWS7 |
| UPI000675D9DD | A0A098RE99 | UPI0004212DE4 | UPI0005C15FEC | A0A097QPF1 | UPI0005D339A3 |
| UPI0004D8E29C | E1VCA4 | A0A0C4WTU2 | E0FET2 | A0A0H0Y092 | I0QQI6 |
| B7UMN3 | UPI00030B6E67 | C1DJY5 | UPI000248B5E1 | UPI0002F588B8 | UPI00038060C2 |
| H4I3H7 | UPI0006148CBA | M9YDT7 | J4TTN5 | A0A0G9M026 | H8NUJ7 |
| H4JUI7 | UPI0005B789BB | UPI0004E1F9C3 | S9YCL8 | UPI0002DD07EC | A0A0H3FLE0 |
| H4KPD2 | S2KK42 | W0E158 | I2NC81 | A0A0B4IM65 | UPI000554A929 |
| H4L565 | UPI0003674641 | A0A0F7K0Q6 | UPI00031355EC | A0A0A3EMP0 | A0A085G3A6 |
| H3KW73 | UPI000343B180 | UPI00048BF236 | E0F2E9 | K5V6E0 | UPI00041ABFF4 |
| H4LJK6 | UPI000376C869 | UPI000395D43A | E0F8J5 | UPI00066B2D3D | UPI0003089400 |
| H4IZH1 | S5T4K5 | UPI00046F29D9 | E0EW49 | UPI0005F9A9ED | UPI0004719479 |
| H4JFJ8 | K0C8L7 | A0A0F5ARC9 | E2P8X6 | M7RIV0 | UPI00058F6D4E |
| H4K9V6 | A0A0F9YVG2 | Z5XTJ6 | W0Q1J8 | K5TSH9 | C8NBT1 |
| E3XW38 | UPI0004057986 | UPI0002AA68F1 | UPI0005856421 | C9QC04 | UPI000660E94E |
| H4IIJ0 | D2TWS6 | A0A0F4S821 | A0A0B5BWF7 | A8T649 | |

TABLE 6

List of *Bacillus stearothermophilus* PcrA homologs that have 50% identity to and 80% overlap. 1747 members
of Uniref 50% identity cluster is shown (citable UniProtKB and UniParc accession numbers are shown).

| | | | | | |
|---|---|---|---|---|---|
| P56255 | J7M5U5 | T0TN09 | A0A0I6PI88 | R3VBE4 | UPI0005CD7F53 |
| S7T032 | A0A0H2UUM0 | F8LQ03 | A5LVX9 | E0G4K8 | UPI000417C0DE |
| UPI00051815BF | Q1JLF2 | C2LSM3 | UPI0005E41D7E | E6GJJ0 | UPI0005CD905E |
| A0A098L684 | UPI0003C7B0E5 | UPI00065FC663 | S7YIM5 | S4DY07 | G7SM20 |
| U2YC97 | UPI000254D55F | UPI00066E20BD | UPI00066CDBC6 | C2H162 | UPI0004062509 |
| G8N340 | Q1J6A6 | E3CPD8 | E1LG87 | R3D1M0 | UPI0004051F87 |
| T0Q4M4 | A0A0G2V0F7 | W3XXV6 | A0A0I6BPW7 | X6SFW2 | UPI000411FB5C |
| A0A063Z1I8 | M4YYG1 | T0T6T2 | A0A0I9JBK7 | X6RK63 | UPI0004022BA7 |
| L7ZT56 | A0A0G4DFH5 | UPI0002AEC4C7 | UPI0005E02B0B | R4CW85 | UPI0004188987 |
| V6VMU8 | UPI0001E10349 | UPI00065FB970 | UPI0005DC8263 | X6RKD4 | UPI0005CE22CD |
| Q5L3C0 | UPI00000D9968 | UPI0003167399 | UPI0005E61B75 | X6SVN5 | UPI000400A66B |
| UPI0005CD09ED | A0A0G3U9S6 | A0A0A1DXP2 | UPI00066DCA04 | R4DBG2 | UPI0005CD5B4A |
| A0A0D8BW89 | Q48T98 | A0A0F3HAQ8 | E0Q0Y1 | C7WG78 | UPI0005BE8F33 |
| A0A087LEV1 | UPI00038E29D2 | V6Q5R6 | UPI00066CD043 | C7W6F8 | UPI0005CC9805 |
| UPI00066FD17E | A0A0H3BYK1 | A0A0C2HKT0 | UPI00066D16C5 | R3EDY6 | UPI0005CC91DA |
| UPI000519CC89 | UPI00050BF55F | UPI0004E153F7 | UPI0005E1DA5A | E0GYA3 | G5L3H4 |
| A0A0G3XVN0 | UPI0004BE2C5F | UPI000288F7E6 | UPI0005E04403 | R3L6W4 | UPI0040C9E90 |
| A4IJY5 | UPI0004F92D8A | A0A031IBW4 | A0A0I6R2B8 | E6FGS3 | UPI0005CE3BAA |
| UPI0005CCA9FF | UPI00066C9AA9 | B1YJ16 | UPI0005E64F07 | UPI00031E170D | UPI0005CCD039 |

TABLE 6-continued

List of *Bacillus stearothermophilus* PcrA homologs that have 50% identity to and 80% overlap. 1747 members of Uniref 50% identity cluster is shown (citable UniProtKB and UniParc accession numbers are shown).

| | | | | | |
|---|---|---|---|---|---|
| S5YVH0 | E7PYJ1 | UPI0006AA2516 | UPI00066B4226 | E2Z449 | UPI0005CD5201 |
| UPI0004DF596F | UPI0004BE34CB | UPI00047948D2 | A0A0I7U0N9 | UPI0002F39C67 | UPI00040A255C |
| A0A0E0T7W1 | UPI0004BE2973 | UPI000683717C | UPI0005DBFF52 | E6IN81 | UPI000419AA26 |
| UPI0006A962ED | C5WGR7 | UPI00041CB696 | A0A081PQV0 | UPI00031A4BB4 | UPI00040A186C |
| UPI00017E56F4 | F5U8K1 | K0A8A5 | E8KBG6 | S4G3W1 | UPI00042221FBB |
| UPI0001D581E8 | A0A0E4B7C5 | U6BA96 | UPI00017C1A3F | S4FMR9 | UPI0005CDC9EE |
| UPI000424F449 | Q5XBW2 | UPI00047AE0FA | A0A0I8Y7H2 | C7VZ55 | UPI0004624A9B |
| A0A0J0V9H4 | Q1JGI8 | UPI000494D4D3 | UPI0005E6A918 | C7UKX9 | F4EF32 |
| A0A093UDD5 | UPI00044FEC83 | UPI0004792A31 | A0A0F2E3V6 | A0A0E1C082 | UPI0005CF3160 |
| UPI000539F1EA | K4Q9V2 | UPI000494A958 | UPI00066DA31C | R1KTX5 | UPI000400B1DD |
| N4W917 | UPI000617EC21 | U7USF2 | UPI0002AF45D8 | UPI00045B8E48 | UPI00040B8112 |
| UPI00055386C0 | UPI0003C7BD0F | A0A0E0UWM6 | UPI00066EE4B6 | R2UDI9 | B9WTD9 |
| UPI0005590F34 | A0A0F5P2U0 | A0A0E1R8Q5 | A0A0I8ZZI4 | R3B3J0 | UPI00041EA41C |
| UPI00020D9901 | UPI0003C7D5B0 | A0A0E1Y218 | E0SZL7 | R3J9A8 | UPI0005CEFECB |
| I8UBH1 | UPI0006181569 | A0A0B8RF49 | UPI00025ABE1B | UPI00032DCFB5 | UPI00041FE6F0 |
| UPI000555B2C6 | I7WIP9 | UPI000035D23A | A0A0I7UZI3 | UPI00032F5E7D | UPI0005CE9E1B |
| UPI00059000A4 | A0A0G2V4A4 | UPI0001B43587 | UPI0002313C8F | A0A0H1TNE2 | UPI0005CED2C1 |
| A0A089XIR5 | I1ZL68 | UPI0003591B75 | UPI00066E2824 | R3C367 | UPI0004128A2C |
| T0TNV3 | E8K3X2 | UPI0005128D3B | A0A0I8XVX0 | R3VC46 | UPI0005CF2FFD |
| A0A0H1RMM4 | W1Y2G0 | UPI0003EC8641 | UPI0005E6A956 | V7ZS55 | UPI0003FA464B |
| D2BQM2 | W1VGX2 | A0A0H4NBP6 | X8KE98 | C7YF48 | UPI0005CDDD5E |
| A0A0A7T646 | UPI0002F353EC | A0A097B674 | UPI00027EA587 | R3W0C9 | UPI0005CD2C43 |
| T0W2G0 | F8DFS6 | A0A0F5Z989 | A0A0E7WHF5 | C7UTX1 | UPI0005CE703E |
| H5SYV7 | UPI00031E513E | E3ZRG0 | UPI0005E9B66A | C7UDZ4 | UPI0005B9BF22 |
| A0A0B8QL14 | E7SC56 | UPI0006282029 | A0A0I5V7V4 | C7WW04 | UPI0005CCB173 |
| G6FEQ4 | UPI00021BD63E | UPI00052F1B16 | UPI0005EA0304 | R3KHA0 | UPI00005CD2248 |
| Q9CGH6 | I2NTT3 | A0A0H0TBR3 | UPI00066ED988 | R3KQT9 | UPI0003F9DC72 |
| F2HJH7 | UPI00065F8C03 | UPI0001975CA4 | A0A0B7LAG3 | U7S5K0 | A0A075SIP2 |
| T0V8Q3 | UPI00066A6FE6 | UPI00003CA336 | M5K5E4 | R3Y2U6 | UPI0005CCB671 |
| U6EMQ9 | U5P378 | A0A0H3GCW7 | M5K8F4 | R3ATF7 | D5AH63 |
| A0A084A9A3 | A0A0F3H3Y1 | A0A0H3IUG2 | M3IAM8 | R1LJ35 | UPI0002195DB2 |
| Q02Z69 | W1VGW0 | UPI000431635A | D3H992 | R3NBA7 | UPI000367B16E |
| U5PKA6 | UPI00066BB1D3 | UPI000396C49F | UPI0005DADCC0 | R3PMA1 | UPI00040780E6 |
| A2RL58 | U5PAT9 | UPI00057E5CD1 | A0A081QTN0 | C7WTA5 | UPI00047DE9FC |
| T2F5M7 | UPI0004E25F53 | UPI000541B044 | A0A0F2DL31 | C7V916 | A0A0D6A4Q8 |
| K7VSC5 | UPI0006600922 | UPI00065E0E60 | E9FH57 | C7VLS1 | UPI0003079325 |
| T0VAM5 | UPI00066E3612 | UPI00059B4903 | K0ZJQ5 | R2VJF4 | W1SU53 |
| UPI0006172C2A | V8BFU1 | UPI00064CDA40 | UPI0005EA108D | C7VRD8 | K6DTK1 |
| G8P2F6 | UPI0006605290 | A0AJL2 | A0A0I8KXT3 | R3I2U9 | UPI00058D7294 |
| S6FGR2 | UPI00066EBF4B | UPI0004F3EE62 | G6R9C9 | R3I1C1 | UPI0005F025AA |
| UPI0005838B59 | F9M2F0 | UPI000570B4C0 | A0A0I8MDZ1 | U7SAR7 | UPI00055EBF2F |
| T0UFT5 | UPI00066C8E1F | H1G7W7 | X8HMR1 | R3DJQ9 | A0A0F3RNZ7 |
| Y1QH73 | UPI00066A3914 | UPI0004D59A43 | J4Q880 | R1JZF5 | UPI00005534922 |
| UPI000629DD6D | UPI00066CB902 | G2ZBE3 | W3XTS5 | R4ALC3 | E7FSU1 |
| Y1Q968 | E3CEE7 | A0A0G2WHH3 | UPI00066C1FD6 | R4B5K9 | G2SLV9 |
| UPI000376C4D7 | UPI00066DB632 | A0A0G2W8X5 | UPI00066BE89C | Q837V7 | A0A0G8G5N5 |
| A0A0D6DXQ0 | UPI00066D30C4 | Q92AP9 | UPI0005E8CD89 | A0A0E1RBS1 | R6S5W5 |
| R2SEZ2 | K8MRD3 | Q8Y6C9 | K1ABC3 | A0A0F5AWZ1 | A0A0G8G9A4 |
| UPI0003F7ADC6 | UPI00066D94ED | A0A0G2VQM3 | K1AGK6 | A0A059N1T2 | A0A0B4B1V1 |
| F9DT42 | UPI00066CDADB | A0A0G2VT50 | K0ZZ87 | S7U796 | F7R373 |
| UPI000054EA513 | A0A0F3HXT7 | UPI0001EBB745 | A0A0I6M9Y8 | D4EPU4 | UPT00062CB1C4 |
| UPI00030811AC | I7IYF1 | UPI00066D78F0 | UPI0005E36939 | U6RZD7 | UPI000409F2F6 |
| UPI00036C3403 | UPI000345D943 | E6J2G2 | UPI0005E225FD | E6ISD3 | C0WZU5 |
| S0KSL1 | Q8ES83 | UPI0002FD7F0C | A0A0I7LKZ4 | J6NDX6 | A0A0G9GFB1 |
| A0A0A5GAU1 | R2R7H3 | W1TUK9 | A0A0F2DPD4 | S4GCT9 | V4X193 |
| UPI000414CEF0 | R2VFE1 | I0S6A8 | UPI0005E11B6C | C0X2D5 | A0A0F4HGR5 |
| A0A078MEE0 | R2RQ91 | UPI000660E090 | A0A081QG94 | J6PVS6 | U2HDV7 |
| UPI0004103FCF | S0RUY8 | F5U2X9 | I0SZR9 | J6ESY5 | D8IIP0 |
| M1Z7Z9 | UPI000051A74A9 | U2XKT4 | UPI0005E14969 | S4C6D0 | T0SLF0 |
| UPI0001850A35 | W9EJ23 | K8YYY0 | UPI00066A9D62 | J6GZ70 | D0DT13 |
| J1HTP8 | UPI00028D8F83 | T1ZV68 | A0A0E8P896 | E6H2K6 | R4RJL7 |
| F0ELG6 | K0IW42 | A0A0E2IST8 | UPI0005E5529F | E0GC91 | UPI000582B547 |
| UPI0002E3189C | UPI00059D08F4 | I0SM41 | A0A0B7M600 | E2YA71 | UPI0006657CCS |
| T2NS83 | E5WTD2 | UPI00066B626D | A0A0I8X1A0 | S4DTD6 | B2GDT0 |
| UPI00042432D9 | UPI00047A5B10 | UPI0003906A09 | UPI00066A9CD2 | E0HHS0 | A0A0G9GHB4 |
| S4E2N9 | A0A0J5YRT7 | J5H823 | I0STF6 | J6CZA7 | A6CTQ5 |
| UPI0004065D0D | UPI0006A9BD02 | F9P5H7 | UPI00066EB944 | E2YXC8 | UPI000468231D |
| S4B0D0 | UPI00031F0DBB | UPI0006612AD9 | A0A0H2UPX1 | J6F8R9 | A0A0A2TG25 |
| UPI0004080059 | W7KMF0 | UPI0003908243 | V8IKB2 | E6HPG5 | K9ECC9 |
| C8ZW14 | G5K2S6 | UPI00066D6CAA | B2IQ19 | J6LKR6 | UPI00048127F0 |
| G5ISN9 | I4X463 | G6A4N0 | A0A0E7X876 | J5ZVI4 | G2KVV1 |
| R2PGJ0 | UPI00052FEEE4 | UPI00023296C1 | UPI0005DD5C54 | J6QD02 | G5KC28 |
| C9CH47 | A0A098EQM7 | UPI00066A46EE | A0A0I9AQP0 | J5DL74 | F3L6C7 |
| C9A7W5 | W3AD61 | UPI00066A7CBF | S9RFX3 | J6EQP8 | UPI0003106D0B |
| T0UB13 | A0A0B4RAA8 | T1ZDX9 | UPI0005E228BC | J6NTK1 | UPI000419C333 |
| A0A0C2Y4G1 | UPI0069FBE5D | X8HC25 | UPI0005E426DE | J6PAC4 | UPI00047C345A |
| A0A0D0Z5K2 | F6CR29 | A0A0C1HWD2 | UPI0005E7453E | D4EZ78 | UPI00069F1374 |

TABLE 6-continued

List of *Bacillus stearothermophilus* PcrA homologs that have 50% identity to and 80% overlap. 1747 members of Uniref 50% identity cluster is shown (citable UniProtKB and UniParc accession numbers are shown).

| | | | | | |
|---|---|---|---|---|---|
| B4U2N2 | G8PE15 | UPI0001F606A4 | S7XP08 | E6IB45 | A0A0J6BIJ7 |
| UPI0005BB133A | V7HVC5 | U2YEQ3 | UPI0005E54BE5 | E6EW25 | UPI000345FA17 |
| C0MG96 | A0A0F4LU79 | UPI00066AA721 | UPI0005E4BCD8 | J6LYS0 | C0Z4D5 |
| A0A0D0ZF61 | C7XVU9 | A0A0E9EVC1 | A0A0B7L333 | E0GI65 | L5MLM9 |
| A0A0E1DXS1 | F6B7U9 | UPI00066A249D | R0N6B7 | C2DEW5 | J2ICT3 |
| A0A0D1AJJ8 | UPI0001FAE64A | A0A0H4QJH6 | A5MXJ1 | E6HGC1 | J2GML2 |
| UPI0005BB6148 | UPI0004119D25 | A0A075QWT2 | UPI00066CEE14 | E6GUV7 | UPI00036424CF |
| A0A0G7A7Q1 | E1UN03 | UPI0003821CF7 | UPI000352C53C | E2YIL6 | A0A0H0SII0 |
| UPI0002175097 | A0A0A0TU62 | H0UC09 | A0A0I6M0R5 | T2P3G0 | UPI000673AC8A |
| C0M8W6 | UPI00006480DA4 | UPI0003B19331 | J0UC50 | J6R7F3 | UPI00037AD71B |
| A0A0G6YRU4 | I2C272 | A0A0F7BZE | F9PC08 | J6QBF0 | D6XYW2 |
| A0A072ELK0 | A0A0E1LP36 | UPI0005556E3B | UPI0005E65946 | T2P2M8 | UPI0005A0C938 |
| UPI0005B9A818 | UPI000458757A | UPI00029B0B59 | UPI0005DEEC80 | C2JPD9 | K0NSF0 |
| N1ZT17 | UPI000245 8DDC | UPI0005A8DE74 | UPI0005DB5FE3 | F3R2R2 | K0NWD9 |
| A0A062X6V6 | UPI000471D8DA | UPI0004936DE9 | UPI0005DB0E2B | C2JPD8 | I7JV33 |
| UPI00046A8E16 | A0A0G3V8X1 | UPI0003104D4F | A0A0E9A2L0 | J6F4X7 | UPI00039E5A1A |
| UPI000219434D | A0A0D1IMY3 | A0A0G2Z1V7 | G6PSM2 | UPI000665D580 | UPI00066064E2 |
| UPI00054D6FB4 | U1YND2 | A0A0H1T5V3 | A5MAN0 | UPI00053BEB7B | UPI00004959EB5 |
| Q5FLL5 | UPI00069E39D3 | UPI0002BAE34A | H7JF57 | W1VWC1 | UPI00020DA0D4 |
| A0A094K9S3 | UPI0002F6BFBB | K0JN87 | D6ZSN4 | UPI0002FDF1DC | M7NB45 |
| UPI0006735FF0 | UPI00028966FC | UPI0002BAFF71 | UPI00067E3BD1 | UPI00032EF110 | I4D367 |
| UPI0002F19FB8 | UPI0005F96F19 | I0Q912 | UPI000032ED949 | UPI0005A135DF |
| F8DMZ0 | A0A0G2YPJ5 | A0A0H1VSP1 | J0VYU9 | UPI00032DF268 | UPI0005A135DF |
| A0A073K223 | M4KP62 | A0A0H1VST5 | A0A0I7N7X2 | UPI0006611725 | UPI000557D9AE |
| A0A081NN78 | UPI000467CBC2 | A0A0H1XJQ7 | B2E1F7 | R3KQ79 | UPI00040DC1E5 |
| UPI0002DA8E1F | UPI0004E7B7B4 | S8PCV2 | G6S5S7 | UPI00032D8816 | G5JVH9 |
| S5N6B2 | UPI0002A11EAA | S9B2B8 | G6LMK2 | UPI00032F27BE | A0A061N7C8 |
| C0YY61 | A0A0G2LYN9 | F8Y0Z9 | C1CE74 | UPI0004244B9B | UPI0005525FE7 |
| A0A0H4L928 | UPI00046ED5B5 | S9MTU2 | A0A0I9HKT6 | R3JUC0 | UPI00034C8C5C |
| A5VLG7 | UPI00006529B7C | S9CV37 | A0A0I9C672 | UPI00045A0DF5 | D5D9D8 |
| R9WGA8 | L8PVW0 | S8FGZ3 | UPI0005E5C16F | C7CXQ3 | G2RXJ7 |
| F8KEB4 | E0TU76 | S9BAQ5 | UPI0005DF7A6C | I7BW34 | A0A0H4R638 |
| B3XPD6 | A0A0D5D2X4 | E7S415 | UPI00066DA9B2 | A1HME8 | D5DWY1 |
| A0A0F4LTY8 | UPI0002B6EC1D | UPI00046CB8EA | A0A0I7G3B6 | Q5WJ31 | A0A0F0J8P4 |
| UPI000487320D | UPI0002891107 | UPI0005E2BE93 | A0A0F7Y925 | UPI0002FD32D5 | A0A0B6AB4 |
| D5WUX8 | D4G620 | S8FZ09 | UPI00039C59B5 | UPI00067A2901 | UPI0005B4512E |
| UPI0002F118C8 | UPI0005AD3458 | A0A0H1GG85 | A0A0I5N723 | S2XF35 | UPI000682E43B |
| UPI0001E89712 | UPI0002865556 | Q8DZF9 | A0A0E7ZAF0 | UPI000679FA7D | A0A0J5USU5 |
| A0A0J5GSJ3 | O34580 | A0A0H1WCN1 | UPI0005E318B4 | A0A0A8HNC8 | A0A0J1IVB0 |
| UPI00068A6D6D | G4EZ92 | A0A0H1YVD6 | A0A081PXD6 | A0A069F1G6 | UPI0004733E51 |
| A0A062XR18 | A0A0A1LU02 | UPI0002BE4DD4 | UPI0005E614FB | A0A085UDQ4 | UPI00047C38B4 |
| UPI00021964BD | L8ADL0 | UPI0005DE829A | UPI0002735B06 | UPI00036BDB49 | A0A0J6WUD7 |
| UPI000415247A | UPI00046730CE | A0A0H1IDA8 | A0A15WGP4 | A0A094WEU8 | A0A098ESM7 |
| V6Z3H5 | I0F1C0 | A0A076YVH2 | A5LMH1 | A4J705 | UPI000423B330 |
| UPI0004205ED9 | UPI0003A70724 | UPI000332E0DF | UPI0005E59371 | UPI0006527050 | UPI0003882373 |
| UPI0003817B64 | UPI000416C8D9 | A0A0H1LVT6 | UPI0005E5CDC9 | UPI00053C5AB9 | A0A024QGT6 |
| A0A0J8G63 | A0A0F5MHF6 | UPI0002B9E962 | UPI00066E2A51 | UPI00099YFE2 | UPI00036A8D74 |
| M3GSH8 | UPI0002A13E19 | UPI0002B9AAC1 | UPI00066DCBF7 | A0A0D4CNA9 | H1LDA7 |
| H7F3P6 | UPI0002416823 | S9MD09 | UPI0005DAF614 | UPI0003FBD3F6 | UPI0002E51DEA |
| W7DTL5 | A0A0F0AC16 | S8NNN7 | UPI00066C80E0 | UPI000378183D | H3NEA0 |
| G0UES1 | I2HNA7 | S8P6Y4 | K8MSF0 | UPI00002E4B790 | UPI00058BA923 |
| C5RBQ7 | UPI0002E6650E | S8QFS6 | C1C784 | G5KGH3 | A0A0A3TV65 |
| D7UU99 | UPI0002AA99BF | A0A0H1NAH8 | UPI0005E0C55C | A0A0F3HRU1 | K8E0T1 |
| W7BIE4 | UPI00057C2EC9 | UPI0002F54753 | A0A081QQF8 | J7TJ76 | UPI0003F5E34D |
| W7BQB1 | UPI0003872E1B | UPI00028CE135 | A0A0I6RW2 | F0I8F9 | A0A074LMV6 |
| A0A091BQ28 | A7Z260 | UPI0002BE2494 | UPI0005E787E3 | F2CE01 | W7CP40 |
| B1SEW1 | S6G180 | A0A0H1HP61 | A0A081Q205 | E8KQC7 | N0AL42 |
| UPI0005C4C4A5 | UPI000398030A | S8P0E2 | UPI0005E3629B | A0A0F2CZP2 | J0L6J5 |
| S5RL61 | UPI0003A660B0 | Q8E525 | UPI000023100D2 | F2C6S2 | UPI0004915921 |
| UPI0005C46508 | UPI000345B919 | A0A0H1DLQ4 | UPI0005E1CE26 | N0CB15 | UPI00035FC8AB |
| H6PBJ7 | UPI000665EEF6 | UPI0002E871D3 | A0A0I7RCB5 | A8AXV7 | UPI000525E54F |
| UPI0005C676D5 | A0A0D7XRK8 | S8VI39 | UPI0005DADB38 | UPI00066BA6D4 | R4KJT8 |
| T0UQQ7 | UPI00038048E7 | UPI00030AEE41 | UPI0005E20280 | D0RVG1 | UPI00024669AD |
| A0A060RKS5 | UPI0005A43216 | K0JMH9 | A0A0I6RJI8 | F0I0L3 | A0A0A1IK06 |
| F5X182 | UPI00057BD0DF | UPI0002B8C27C | B1IBM7 | F0FSG1 | Q9S3Q0 |
| UPI00066000C4 | UPI0005EBB97E | UPI0002F07C72 | UPI0002ADCFE5 | UPI0006B25214 | B1MXQ7 |
| F5X6S0 | UPI0006AE6F38 | A0A0H1Z5L | A0A081QYR3 | UPI00066A525C | A0A098BA44 |
| E0PDX9 | A0A0H3DY38 | I7ISP9 | UPI0005DF6E72 | A0A0F2CRI4 | H1WSK1 |
| A0A0E1XF14 | A0A080UNJ0 | A0A0H1T3F9 | UPI0005E41938 | A0A0B7GK35 | A0A069CV32 |
| H2A6M7 | UPI00022BA657 | A0A0H1MS35 | V8IC09 | F2BSX1 | UPI0005F00C2A |
| A0A081JHH2 | A0A0C2PX57 | A0A0H1V4C2 | A0A0B7L5V0 | UPI00066034B | A0A081BK49 |
| UPI00051C02C3 | UPI0002DC92B0 | S9APZ9 | I2J4H2 | UPI00066616F5F | A0A0A3HZB |
| UPI000410E728 | UPI00066FBF08 | S8FYF6 | A0A0I7VHR8 | F0IU30 | F4BLW5 |
| UPI0004D4E3B7 | G4NUA0 | S8HPX5 | UPI0005E06D6A | A0A0F5MJY5 | U5SAC6 |
| A0A091BNX2 | A0A068LM65 | UPI00046C8FD9 | UPI000318BEDD | F3UWM7 | A8U4Y8 |
| E8JNI7 | UPI00025F1BD8 | K9AHW3 | A0A064BXT9 | UPI0006603308 | UPI0005590D06 |
| UPI00040D1DBE | I3DZY5 | UPI000554B661 | A0A098ZS00 | F0INA4 | UPI000550B1B9 |

TABLE 6-continued

List of *Bacillus stearothermophilus* PcrA homologs that have 50% identity to and 80% overlap. 1747 members of Uniref 50% identity cluster is shown (citable UniProtKB and UniParc accession numbers are shown).

| | | | | | |
|---|---|---|---|---|---|
| UPI00041D9E3E | A0A0F4M491 | C2E4W5 | S2UT89 | UPI0006605CF8 | UPI00054D85C0 |
| W7ZBP8 | UPI0005145490 | UPI0002FE2AC2 | UPI0005DBEB5A | UPI0001FBB9D8 | UPI000553C539 |
| A0A060M0P3 | A0A0F4LJ28 | A0A087QEX7 | UPI0005E44ED7 | A0A0F2CJE0 | UPI0005C4A619 |
| V6M8R1 | A0A0F4LIP7 | UPI0000459CDE | UPI00067A8E24 | UPI0003D2BF73 | UPI0003B36792 |
| A0A075LMV5 | A0A089Y3J1 | A0A0A8B472 | UPI0005EA38C1 | A3CM74 | UPI0005CE4434 |
| U5L6Q7 | A0A0F4LHL3 | UPI00057E310A | UPI0005DFA93B | UPI00066124BC | I7LCW7 |
| Q2BBV3 | UPI00066D84FA | F7SF58 | UPI0005E43F38 | UPI000204C9B3 | UPI0004942515 |
| J9YKR2 | UPI00047168BE | UPI00069ED3EB | UPI0005EA228D | E8JTX8 | U1N3Z8 |
| B9E831 | UPI00031D0F4F | D0R5K3 | UPI0002D988F7 | F3SII1 | UPI0004DFB32B |
| A0A0A5GC60 | A0A033UAP9 | Q74I48 | UPI00016C30E9 | F3UBI9 | UPI000495DE5F |
| UPI00068F9B5A | UPI00065B9E05 | V5P429 | A0A0E9GYK1 | F0FE53 | C4L2B1 |
| D5XD67 | UPI00030B5B12 | F4AC33 | UPI0005DF5506 | F9E172 | A0A099DEL3 |
| S4D0X9 | R2S3I5 | UPI000660D235 | UPI00066C8BEE | F9HGV1 | UPI000554029F |
| UPI00040BD27E | UPI00005BB07E7 | UPI00066974FD | D2ER82 | F3URE9 | S3FYE4 |
| W4QBS4 | A0A0D1LT71 | UPI000665A968 | G6JAI2 | A0A0A0DGR7 | UPI0004787EFF |
| UPI0001E98CB8 | A0A0D1LUL0 | UPI0003421E15 | A0A0I8YKR7 | UPI0066B8271 | A0A069EVD4 |
| C8PBZ7 | UPI0002191623 | UPI0001A57BCC | A0A081R5K4 | W4F985 | UPI000426A771 |
| UPI0001E2B095 | D8MGK9 | D1YI75 | A0A0I9KK18 | UPI0006A9F3B8 | S2KHH9 |
| UPI0001FDB18A | D5T1C2 | UPI00050F2122 | A0A0I9KK18 | UPI0052475A3 | Q1GBF8 |
| UPI0002072E3B | F6DPJ5 | UPI00050F4C6F | J1DH18 | A0A087N1S5 | UPI0006800765 |
| A0A0E1XZC6 | UPI0002E9BB91 | A0A0J7K5W0 | V8I629 | A0A078MFK8 | A0A061C4M6 |
| E3BTD7 | L0E9U7 | A0A0J7HHM3 | UPI0005E3DD18 | UPI00037E072F | E4SWU2 |
| G3YXZ2 | UPI000401406C | D3L7Q3 | UPI00066D82D8 | UPI0002F64287 | D8FRH5 |
| E1NV43 | A0A0A6NWI1 | Q04GN7 | E1LLK4 | UPI00040FF648 | F0HX91 |
| UPI0001FD875B | UPI00047166B2 | UPI00050F2BFE | A0A0I6S0N2 | UPI0002FBC45B | Q71HW2 |
| E1NLU9 | A0A0A1MVS7 | UPI00050DE508 | I0QC96 | S2XYX9 | UPI0000510635 |
| UPI0001E5D8E8 | UPI000595B757 | UPI00050F1464 | UPI0005DCF59C | A0A0E4H7N7 | A0A061CFU6 |
| A0A061P6S2 | J3F9X4 | A0A0E2VR29 | A0A0D6J8D1 | UPI0004758748 | UPI0006829E76 |
| A0A061NMB4 | UPI000410FF91 | A0NL49 | UPI00066CDBD2 | T0BRJ1 | F0K0A9 |
| UPI000364DDD7 | UPI0002F4C1DE | UPI000277B8D1 | UPI0005E4C005 | UPI0004CECB95 | A0A061BVE6 |
| A0A0A3I330 | UPI00046A2EE8 | UPI00050FB3CA | J5GJF0 | UPI0002DA0189 | G6F4X4 |
| A0A0A3J757 | F0NVP6 | UPI000277B786 | UPI0005E2E74F | UPI0002E0B711 | UPI00032F7094 |
| UPI0003107DC7 | UPI0002DD6873 | UPI00050DA477 | A0A0E8AXP8 | UPI00037D657F | A0A061CH35 |
| UPI0004658065 | W5XDQ0 | UPI000277B3EF | F3VID1 | UPI0005B651F3 | A0A061BSV4 |
| UPI0002B59EE5 | UPI00046C96B8 | UPI00050EBFE8 | E0TNB3 | UPI00031B78EB | A0A061C0Y8 |
| UPI00031ED71B | C2KB80 | C2EVD7 | UPI00068136F1 | UPI0002DA8172 | G6EVU1 |
| UPI0004225966 | UPI0002E9360C | UPI0004953241 | UPI0005DD3E82 | UPI0002FE6543 | UPI00069A32A5 |
| UPI0002B55DD2 | UPI0001B2ADB8 | UPI0004256505 | A0A0I6F783 | UPI0002EB9E28 | UPI00034B89F3 |
| UPI000268A7D1 | D5H1T9 | R9TUH2 | UPI000680414A | UPI000362867B | V4QC95 |
| UPI0002DD3475 | V5E0D8 | A0A0J6H039 | I0Q427 | E3CGX4 | UPI000287FE90 |
| UPI0003140F32 | U6FUY0 | A0A0D7XCT2 | UPI0005E1E1D9 | UPI0003675904 | UPI000493F21F |
| UPI0002DF577A | U6FDW7 | A0A0D7XAM9 | F9HM88 | UPI0002BE1554 | UPI0002F64068 |
| UPI0002B52183 | U4QEF3 | UPI000470EB15 | R0NC47 | UPI00036D9746 | G9ZMU8 |
| UPI00030AAF28 | C2ELL7 | A0A0H4X8R6 | UPI0005E3138C | UPI00031BD2D4 | I7JG80 |
| UPI0002B54D20 | F6CEU6 | T5HV53 | F9HDZ5 | U2KML1 | UPI0002490095 |
| UPI00030ED4DD | A0A0D5MK99 | Q65MR3 | UPI0005DF6040 | UPI0002F0FB31 | A0A069DTV4 |
| UPI000317D564 | U6F2P2 | UPI0003A92B3A | UPI00066DF5D2 | UPI0002DF3A61 | UPI0003718539 |
| UPI0002B5AC18 | A8YTZ2 | M5P7T2 | UPI0005E78EF0 | UPI000309D239 | A0A0A5GG76 |
| UPI0002B53160 | UPI000468D9FF | A0A0F5KXW3 | A0A0I7SUM9 | UPI0002E4AADA | UPI00040E6B55 |
| UPI0002B5578F | UPI000698FD57 | A0A0J6ENX9 | UPI000399E547 | UPI0002EFE60F | UPI0005CD2072 |
| UPI0005D5DE55 | F0TDD1 | A0A0J6ES4 | UPI0005D5243 | UPI0003714975 | UPI000487D20C |
| UPI0002FFCB1B | F2M355 | UPI0005A16A5C | UPI0005DBEC58 | UPI0003773AA6 | UPI0003720301 |
| UPI0002B50165 | R5ZGC9 | H6NTK0 | UPI0005E3FBD1 | UPI000375ABD2 | M3HNA0 |
| UPI0002B5E93C | E4SM94 | F8FKW5 | D4FT83 | UPI0002DE0320 | UPI00020CBEE6 |
| UPI0002B560C6 | C7XLR3 | UPI0003F50A86 | G6CA70 | UPI00035FC09C | A0A0A6UX77 |
| UPI0002B58B2 | J4BVM3 | G9WIE0 | A0A0B7LL60 | G5JQP7 | A0A0E2USS7 |
| A0A0E2ES03 | D0DI93 | UPI00054F4F52 | R0MM09 | UPI0002E29189 | F1Z0K5 |
| UPI00030C4A19 | K1MXE4 | A0A090IVN1 | Q8DPU8 | UPI00037CA55E | UPI00041B294C |
| UPI0004648E2C | U6FHU9 | A0A0D0FW99 | A0A0H2ZN88 | UPI000379270F | UPI00513CEDF |
| UPI000358C8 | F3MR07 | A0A0D0FHN9 | A0A0I5SPG | K8Z8B4 | G0VS69 |
| UPI0003111877 | W7YRH9 | A0A0D0F833 | E0PRK3 | A0A087EPN1 | UPI0004221C8D |
| UPI0002DA340C | W7Z816 | UPI0002195446 | UPI00066AC65D | A0A063B7B8 | UPI0004858886 |
| UPI0002EE7FD7 | V6J250 | J2ZKY4 | I2J7J6 | UPI00054DF8E8 | UPI000356EF52 |
| UPI0002D4555C | C0WSC1 | UPI0002192DE8 | F5W0L7 | UPI0006B251F7 | R7MZQ6 |
| UPI0002B513D0 | C2D3L0 | A0A0J1HWV3 | S3BFG0 | UPI0006B25740 | UPI000550AF6D |
| UPI0002B5E0D9 | C0XHM8 | R9BWL2 | E8K074 | UPI0006B25166 | A0A0B0IKT7 |
| UPI0002D9F995 | F5L444 | A0A073JY52 | UPI00066B28A6 | A0A0C2WKV7 | W4QVT6 |
| UPI0002E8D24F | A0A0G9MI18 | UPI000482AB97 | J1S8C6 | K0DDF5 | UPI000054D3339 |
| UPI0002B58C84 | Q03Q12 | A0A0E9GQ05 | UPI00066E5C86 | S0NID8 | F9VEL8 |
| UPI0002B53813 | U2PJH7 | UPI0002D32EA8 | F9PWL8 | UPI0003F6F988 | V8ANU3 |
| UPI0002B5E4B1 | M5AEL4 | G6LUK0 | UPI00066E06C6 | UPI00047D412F | UPI0006226EE6 |
| UPI0002EFF9CD | A0A0H4QAV4 | UPI00067AB63B | UPI00066CF5FD | UPI00004016A4F | UPI0002D66EB7 |
| UPI0002B58C9A | UPI0005B64156 | A0A0I8X5X0 | A0A0F3H5E8 | UPI0040AD781 | K2PIY1 |
| UPI0002B58360 | UPI0004882072 | UPI00066B62FD | UPI00066B0571 | G7SH52 | A0A098CN34 |
| A0A0E2EHS3 | A0A0C1PU47 | UPI0001DDD26E | A0A0F2DYG6 | UPI0003FB4C2E | UPI0002266D5EF |
| UPI00030C12E8 | UPI00041E7D06 | UPI0005DB8FEA | A0A095ZC63 | UPI0005CE1998 | UPI0002FD1A27 |
| UPI0002B55BAC | J7LCK3 | UPI00066EE137 | A0A081SAK2 | UPI0005CD605D | UPI00031F2D35 |

TABLE 6-continued

List of *Bacillus stearothermophilus* PcrA homologs that have 50% identity to and 80% overlap. 1747 members of Uniref 50% identity cluster is shown (citable UniProtKB and UniParc accession numbers are shown).

| | | | | | |
|---|---|---|---|---|---|
| UPI0002B4E249 | A0A0A7U0Q8 | I0SAQ0 | UPI0005342342 | UPI0005CDF885 | UPI00031F5691 |
| UPI0002EC6AC7 | UPI00068191BE | F9MKL8 | A0A081Q0K0 | UPI000424E658 | UPI0005AA507F |
| UPI000466520E | Q03YP2 | F2QD74 | UPI0005358034 | UPI0005CCF850 | UPI00040E6C2A |
| UPI0002B5A6DE | UPI0005A1E84F | A0A0F2DG50 | UPI00067A78F3 | UPI0003F512C0 | UPI000472C523 |
| UPI00046753B6 | C2KL56 | UPI00069CF310 | UPI0005CCF8E5 | UPI0005CCF8E5 | UPI000373D4CE |
| UPI00031B4772 | T0VWY9 | A0A0F2D2Q6 | H7QP48 | UPI0003FB972A | UPI000672387D |
| UPI00046312FB | UPI0002341443 | UPI0005EA00F8 | J1V408 | UPI0004079443 | E7RJR7 |
| UPI0002D7CB42 | UPI0005A6A464 | A0A0I8VWS0 | E1MA03 | UPI0004030821 | A0A0A2UWH4 |
| UPI000466DCC8 | UPI00046CA6CE | A0A0I6VM15 | UPI000411F965 | UPI00040E7BC1 | UPI0002880C4F |
| UPI0002B550C2 | UPI0006814228 | A0A0I8S594 | UPI0003751A95 | UPI0005CD07D9 | A0A075TVF2 |
| UPI0002B59082 | A0A0H4N937 | A0A081QA48 | C8P6C2 | UPI0005CDB669 | UPI00054E004D |
| UPI0002B5EB7C | A0A095AHY9 | A0A0I9J5Y7 | UPI000312AA9F | UPI0005CEAA59 | UPI0005A65B8B |
| UPI0004633B74 | UPI00037F25A9 | M5N794 | E3CAD3 | UPI0005CE6576 | W9ANP4 |
| UPI000264EF92 | B9DUG5 | UPI0005E67219 | UPI00021A3A73 | UPI000409F746 | M9LGB1 |
| UPI0002E7D773 | UPI00062028C1 | G0I9B0 | K0U2M0 | UPI0005D16915 | H3S9K5 |
| UPI0002D3B5B3 | UPI0006203F88 | A0A0E2P693 | U1ES89 | UPI0005CEBA00 | UPI000378CC96 |
| UPI0002B577F4 | A0A0F5I4J0 | F9NZH5 | UPI000660DA3F | UPI00040F513E | K2FNB3 |
| UPI00046662568 | A0A0F5HRS0 | UPI0005E921D9 | C8WTI7 | UPI0005CD9361 | UPI00067F085F |
| UPI0002FBB47E | Q5M4H1 | A0A0H5LNP6 | B7DQB4 | UPI0002322E59 | UPI0001E2EBD3 |
| UPI0002B5379E | UPI0002DE5460 | A0A0E0X8J2 | F8IDV6 | UPI0005CF78F9 | UPI0001FDB5AD |
| UPI0002B51579 | V8LWU0 | UPI0005E64E83 | UPI0005599D20 | R4NWS6 | D4W731 |
| UPI0002B4E9DA | E9DMH4 | F9LXX0 | UPI00005009968E | UPI0005CEAB2F | UPI000490D40D |
| UPI000464DB1E | UPI0003121E5D | X8K6Y7 | UPI0005CABE96 | UPI00040E0B64 | UPI000255C522 |
| UPI0002B529E6 | J7T7E4 | I0T8M4 | A0A0J5S290 | UPI0005CD124C | A0A0F7D4N3 |
| UPI0004671B60 | UPI00031AFBDD | UPI0005E22D3B | A0A0J5WFP0 | U5UIJ5 | UPI00058E169D |
| UPI000319EA31 | E8KV65 | A0A0J5YA29 | UPI0006A9C586 | UPI000042996E4 | UPI000624F4AA |
| UPI0002FFFF03 | UPI0002E8600B | A0A024DEK7 | UPI0006A9C586 | UPI00042A2929 | A0A0A8JEM1 |
| Q8DTY6 | F8HD36 | UPI0005E2SBC5 | C8NHG1 | A4VUA8 | UPI00047BFF10 |
| UPI0002B59757 | A0A0E2QHQ8 | UPI0005E30B11 | UPI0005874702 | A0A0H3MVK6 | I9B3V6 |
| UPI00035CDC0C | F8LX97 | E1M4S7 | UPI00066C1DCE | UPI0005CD2519 | A0A075K9S |
| A0A084GLL3 | A0A0F6BVJ6 | UPI0005E14CCC | D4YVQ1 | UPI000409C6E9 | I9NQ12 |
| A0A084H1D9 | A0A0E2RHF6 | F5VXC9 | E6FS51 | UPI0003FE3351 | UPI0004883363 |
| E6TWN0 | UPI000264F340 | A0A0E8T7V0 | UPI0002EA5AD2 | UPI0041E695A | S4NRZ4 |
| K1LG40 | UPI0000E563DC | E6KMR2 | S4CP69 | UPI0005CDA05A | J9W320 |
| F2F7J1 | UPI000660EC4F | UPI0005E76F14 | UPI0003FECF16 | UPI0004038E95 | F4FSH6 |
| J1GP52 | UPI00066C13CA | UPI0005E0C70E | F2MQT5 | UPI0005CE89C0 | UPI000403AE07 |
| F8HYK0 | F8LIZ1 | UPI0005E6F0D4 | UPI0002A3D37C | UPI0004018E0C | A0A084HBI0 |
| UPI00044D3C3A | G2GTJ2 | S7YYN6 | E0H8L5 | UPI0004404D8AB | D3FTF3 |
| A0A0C6G2S0 | X8J9A0 | A0A0I8TLZ0 | R1W0H5 | UPI00041CFDD8 | U6SL82 |
| U2W3N6 | UPI00066AA528 | E9FJW6 | S4FW64 | UPI0005CDED2A | UPI00036426F2 |
| A0A0E1ENC5 | A0A074IU47 | UPI0005E93C3F | R3UP49 | UPI0005D236D1 | UPI00047A28D8 |
| Q99ZE1 | | | | | |

TABLE 7

List of *E. coli* PcrA homologs that have 50% identity to and 80% overlap. 1029 members of Uniref 50% identity cluster is shown (citable UniProtKB and UniParc accession numbers are shown).

| | | | | | |
|---|---|---|---|---|---|
| P03018 | K8BG21 | UPI0002C8F355 | UPI0005A9630D | UPI0003EF5338 | A0A0J0DJ77 |
| A0A0G3HMD3 | A0A060VDV3 | V1HN20 | A0A0A3YR40 | UPI0001F6648A | A0A0J0SUX3 |
| U9ZBE3 | A0A0E1CLV1 | UPI0002C9B17D | UPI0005EB7A8B | UPI0000678B341 | A0A0J0M6S9 |
| A0A071CB77 | W8V249 | UPI0006811593 | UPI00058E54A4 | A0A0K0IDG2 | A0A0F0XZS7 |
| S1J559 | A0A0J2G3Q6 | A0A0J4VXC9 | H1C573 | UPI0002CC80BD | UPI0005D0A9E9 |
| V2S4E7 | A0A0H4Z3E1 | UPI00025C7C5C | UPI0005CD86D3 | A0A0J5K2Q0 | A0A0C8UHF8 |
| A0A073G662 | V0AU35 | UPI0005304A96 | UPI00044E7286 | A0A0H3MJV2 | A0A0C9HTD3 |
| I2SQY0 | A0A0H4YPU3 | UPI0002CAB12A | UPI00037EE7F7 | A0A0E0VDJ7 | Q8Z3B0 |
| B3X3W4 | A0A0H5AHT5 | UPI0005CCA08F | A0A0J0GVC5 | A0A0G2SID2 | A0A0E7LC59 |
| N2GY76 | W1HG62 | UPI000330B244 | A0A0H0CXK2 | UPI000542989F | W6J799 |
| W1F3C2 | A0A0H4ZLF1 | UPI0002CCBAB8 | V3PV69 | A0A070RYI3 | UPI0004DA823D |
| E1HNQ6 | W9BQA0 | F3WPX7 | A0A0D1KFS4 | H3MUW4 | V8MJC9 |
| A0A070SNS2 | A0A0H3GGJ9 | A0A0F6YD20 | H5V6H2 | A0A070H7E9 | UPI000049F5927 |
| H4URJ5 | A0A0K0GRR7 | K8DQF9 | D7YBR7 | UPI0003BC8E89 | N3EUQ7 |
| M9G7C2 | A6TGJ6 | K8C9V5 | UPI0002C8B609 | UPI0003910486 | UPI0004693D87 |
| N2IIQ0 | A0A0G8G1B7 | F5VR52 | UPI00063CD924 | A0A090UJD6 | UPI0002CCC2BC |
| S1HRC3 | UPI00058FD925 | A0A0D1QDQ1 | A0A0C2AR33 | UPI00004977D3D | F5N8N5 |
| D8E9M5 | UPI00058F49FC | A7MQJ8 | M9I6S8 | UPI0003EF3FD7 | UPI0006A5855E |
| A0A074HPP5 | W1HTQ0 | V5U5I0 | N3K330 | UPI0002CC54C7 | Q83IW7 |
| L2VEY2 | W0ZY91 | UPI0005187950 | I6CD07 | A0A0G3S4T9 | A0A0C7MG10 |
| K5CJK9 | F4T661 | K8D2A7 | E7SHD7 | A0A0H3HA95 | A0A0G3KPN2 |
| D7YG58 | F4V8D3 | UPI0002CA0405 | B2TUW9 | A0A0E0WSN3 | Q0SZ04 |
| W1BJG9 | F4TMH3 | A0A0J0I5H8 | UPI000390185B | A0A068H452 | D2ABY6 |
| N2QEY3 | A0A029LAE5 | UPI000579149A | UPI0005EEDAF9 | UPI0004A0FDEC | A0A0F6MJ85 |
| A0A069YVJ3 | U9YHH0 | UPI0006650689 | B5RFP5 | A0A0H0GX62 | F5P1J3 |
| A0A070Y0G0 | A0A080IB93 | N2J8A4 | UPI0004733206 | UPI0002CB804F | A0A0F6EK00 |

TABLE 7-continued

List of E. coli PcrA homologs that have 50% identity to and 80% overlap. 1029 members of Uniref 50% identity cluster is shown (citable UniProtKB and UniParc accession numbers are shown).

| | | | | | |
|---|---|---|---|---|---|
| A0A073GWJ7 | A0A083YZ93 | A0A063XKV2 | UPI00026721AF | UPI0002CB6B71 | I6BAB7 |
| V0RR87 | UPI0005C48DC6 | UPI0005C63608 | UPI0003A80309 | UPI0004D7856B | UPI00050B7641 |
| V0ACC7 | UPI0005A8BF01 | E7T4T6 | A8ACW1 | A0A084ZTZ9 | UPI00050B2FF7 |
| N2RS67 | UPI0003710649 | A0A0G2XIC2 | A0A0A5IRH8 | A0A062Y212 | I6FW66 |
| A0A069XHA8 | A4WG04 | I6DJM1 | A0A0F1WNC5 | A0A064DKM1 | UPI00067F497D |
| A0A079H1K8 | A0A0J8F6L5 | K0WUD4 | V3DAP7 | A0A080EWZ9 | UPI000530716C |
| A0A074IWT6 | UPI000666003A | E7TCS8 | A0A0E2K1D2 | UPI000668F9A7 | A0A0B1RCP6 |
| F8XAY4 | A0A0I1EMQ9 | Q31UH5 | UPI0004D8D514 | V5AU63 | B6I4F4 |
| A0A074HJR7 | A0A0J5U9E7 | A0A085HAH3 | UPI0003EF42B5 | UPI0002CC06C9 | E9TMV0 |
| V1BCC5 | A0A0J6MG09 | A0A0J5L085 | UPI0005A87CA8 | A0A0B1FRQ9 | UPI0004D72F99 |
| A0A080HWB3 | UPI0006684F9F | I2BE57 | UPI0016A0FB4 | S1FP27 | UPI00025ABCDF |
| I2X3X5 | UPI00058D9C39 | A0A0F1BI78 | UPI000496CFDD | S1L396 | UPI000627F480 |
| A0A070FA84 | A0A0A5RML6 | A0A0J0RXX3 | UPI0006ABEED8 | S1CI55 | UPI000326F8B9 |
| L3K8J5 | A0A085ITJ0 | Y1GM95 | UPI0004646130 | L2VN93 | A0A0F4HLT5 |
| A0A080GHX3 | A0A038CQJ1 | E8C7D9 | B7MR33 | A0A089U9W2 | T9FRL3 |
| A0A073FPS6 | A7ZU18 | V2JXK2 | A0A029IIQ6 | D2TV17 | H5E8S0 |
| S1GRU8 | UPI0002CA1DFD | V1LV18 | A0A029HFI5 | UPI000667BF5F | I4S2D3 |
| H5J8D4 | A0A0F3LUY4 | E8D343 | A0A0J9KSZ0 | UPI0006207A91 | V8FG33 |
| D8ERJ1 | UPI0002481DE4 | S4INC0 | A0A0H0KN67 | I2X271 | I2RVR0 |
| D6I369 | A0A0J8LYC2 | E7ZSL5 | UPI0002CB91AD | A0A0D6IZH2 | A0A070D8G2 |
| A0A071CFC4 | A0A0J8MSQ3 | A0A038D0Z4 | C3SKC2 | B7MH77 | A0A026UZE9 |
| M8SKZ8 | A0A0J8HX73 | E7YUD9 | A0A0H8C28 | A0A0E2KYP4 | A0A028CBA2 |
| S1EV38 | A0A0J8QFU8 | S4J0L5 | V0VC55 | UPI000512AED4 | V0U5F8 |
| S1CHB8 | A0A0J8KFX8 | E7YT71 | V0SS57 | UPI0002C8F6BF | H5A4E5 |
| I6CYG1 | A0A0J8IWX2 | E8F002 | T8ZCA9 | G9YXY2 | G2AN47 |
| H5IRF1 | A0A0J8NMQ9 | E8EDF3 | N4MZW5 | UPI0002CC829C | K3QIJ3 |
| I2WCK0 | A0A0J8JFF5 | G5LW37 | A0A070K8G3 | UPI0004B001CB | A0A070SY69 |
| A0A071DAV1 | A0A0J8M4K3 | E8FVB6 | W1BBJ0 | UPI0004E37056 | I2UC63 |
| A0A070DJ71 | A0A0J8HJM3 | E7VG83 | V0XWV9 | UPI0002C98364 | M9EF05 |
| A0A079D807 | A0A0J8M7Y3 | E8AMN0 | L2X7H9 | UPI000267F8CE | A0A027TGT7 |
| V0YB46 | A0A0J8LY21 | V1PEK5 | T8JFJ4 | UPI0002673104 | A0A0E1SZY6 |
| D8AZQ6 | A0A0J8K6V3 | E7ZUE1 | T5TRC8 | UPI00066D844D | A0A0E2U398 |
| L3IME4 | A0A0J8JD30 | E8B3Y5 | H4I3L1 | UPI0005083EE7 | A0A027ZJG3 |
| I4J587 | A0A0J8KYA0 | G5PV87 | A0A0J3V9C5 | UPI0002CABCFF | C8TL04 |
| T9CEL0 | A0A0J8M2A9 | T2Q2W7 | N4NRN6 | UPI0002C94803 | A0A028E3K3 |
| A0A070ULP7 | A0A0J8KZU2 | E7VUY1 | U9Z163 | UPI0005309A93 | A0A026HN93 |
| H4V876 | J1GHE8 | E8BI66 | X7NZ16 | A0A0J5MIB1 | A0A025G7T3 |
| F3VD13 | UPI000472C058 | S4IB83 | S0YT63 | UPI0002CC9136 | K4VZX0 |
| K3KG98 | UPI0005F8A7CD | E7XYR0 | H4JUM1 | UPI000269547E | K4XMA4 |
| G0F7H1 | UPI0005ED3E27 | V7WD74 | A0A073H2N3 | UPI0003473OCE | A0A0H3XBG3 |
| E6B0S3 | S1I248 | A0A0J6D7Q1 | A0A017I312 | UPI0003910F49 | H9UZ11 |
| E0J3Y2 | UPI000512EA8D | V1U5Z5 | A0A080ECD1 | UPI00057C0D33 | C8UJJ5 |
| A0A037Y8I6 | UPI0002CB816A | E8EQ65 | L5GW49 | A0A0G3PID9 | A0A0A8UGD6 |
| A0A0E2U8R4 | UPI0006815C5F | E8GKX8 | S1P4I2 | A0A0J4WXG0 | UPI0005B345AD |
| E8Y8R2 | A0A0H7LQT5 | E7Y7G4 | V2T0S1 | V3D6C7 | I6FW96 |
| A0A0E0U5P0 | UPI0002CA127F | E7WDV6 | A0A073UI66 | A0A060UYE6 | UPI0004713F51 |
| B7L973 | UPI0003BB4FC5 | E8H1P2 | V6FB56 | M7P8V6 | UPI0002CC83F4 |
| E3PP00 | UPI0002C92D2D | S4M012 | J7RN24 | W8XG71 | A0A0F5SGW9 |
| A0A0E0Y7I2 | A0A0F0YW97 | E8CHG5 | S0XLH4 | V3KJ79 | UPI00069BE650 |
| A0A0E3H4E0 | A0A0F6K2Y9 | S4JDI0 | A0A064T2Q3 | W8XNG3 | A0A069X2G5 |
| C8TYP3 | UPI0002515E81 | V2N400 | M9F528 | A0A098GXV9 | A0A080FIP4 |
| A0A0E1M3W0 | UPI000699EF6E | S4LF58 | S1D3C3 | UPI0004D54D12 | A0A073T7U4 |
| A0A090L9E8 | V3IA60 | E8DQ33 | H4KPG7 | UPI0005EDDA48 | A0A0F1AYX8 |
| A0A0A0F8P2 | A0A0I2HXR0 | V2P0K5 | V8KDE4 | UPI0005F08B1C | A0A0J1YCS9 |
| UPI0005E69EA7 | UPI000579D3C9 | A0A0H5PMN6 | A0A070P4C7 | UPI0002CC5FF6 | A0A0J0HLB6 |
| W1G679 | A0A0J9AH48 | V2ISV7 | U9Y365 | R0D8R6 | A0A0F0RXS9 |
| C0VZH1 | T9ARP5 | V1SA88 | V0YN02 | UPI0002CB96B1 | UPI0005CAF560 |
| UPI0006978729 | U9ZZ52 | T2PQM4 | V4B7K3 | A0A0H0HV04 | A0A0D7LBX3 |
| UPI0003EE8CC5 | B7NFB5 | E8AAS2 | E9YLR4 | S3IGV1 | H4JFN3 |
| W1WHJ6 | UPI000445D59E | E8CTA8 | M8LCT6 | UPI00068E1050 | A0A0J1M123 |
| D8ASL4 | UPI0003EF87D0 | E7WWF9 | M9GJI0 | A0A0J4LFX4 | X7HIN0 |
| UPI0006695A36 | A0A0F4BA88 | E8FMH0 | L3Q9J9 | A0A0H0CH29 | A0A064CY91 |
| UPI0002C95A23 | V5KL37 | E7WRB0 | S0X3S7 | A0A0J0K9Y5 | S0TTK4 |
| W1XFI9 | V2MBS7 | E7X696 | V0Y7G3 | W7NZ36 | UPI0006520C97 |
| UPI00050ADC02 | A0A0H3T6D2 | E8GBI9 | A0A070PK74 | B5EZS8 | UPI0002CC3250 |
| W1WI72 | X5GT01 | V1K5C8 | H4L599 | H7EDN3 | UPI0002CB3E81 |
| UPI0005097CC3 | UPI00056EBE4B | X0NNF5 | S1EDJ9 | UPI0002E3BEE2 | UPI0004DA7107 |
| Q8KI59 | J1QP03 | V2AKC0 | T9IU72 | UPI0004E2422C | Q05311 |
| UPI00044FBFBE | A0A0J2C8A9 | E7VT49 | A0A079Y2R2 | A0A0J5MX43 | A0A0D6IPI8 |
| UPI0005CCFA15 | E1ITF3 | A0A0J6JML4 | A0A0G3J263 | A0A085HQF9 | A0A0E8MI42 |
| Q9R2U0 | A0A0D1CQK0 | V1I8L5 | H3KWA8 | A0A078LAH7 | A0A021WR03 |
| UPI00050A604C | V6FP78 | E8E0U7 | H4LJP0 | A0A0H0R1B4 | S5IH33 |
| V0V674 | V2ASN4 | S4JVA6 | T6GSY1 | UPI0005575061 | V2KFI5 |
| A0A0A7A0U6 | UPI000627EB24 | E7ZFI6 | T6LNG9 | UPI0004D8B75C | A0A0H3SHZ2 |
| E2X518 | UPI000237C903 | V2H9R2 | H4IZK5 | UPI000452C3C5 | E8XJD9 |
| Q329Y9 | A0A0J5L635 | E8BMX2 | T5NEX8 | R8WLR8 | A0A0H3NUG9 |
| A0A0J1JGH9 | A0A085GMJ6 | G5NKF6 | N3MX37 | S0XDX3 | V7QPA0 |

TABLE 7-continued

List of E. coli PcrA homologs that have 50% identity to and 80% overlap. 1029 members of Uniref 50% identity cluster is shown (citable UniProtKB and UniParc accession numbers are shown).

| | | | | | |
|---|---|---|---|---|---|
| W1FYY2 | UPI0005E94CC5 | V2A9V9 | A0A029P4R5 | A0A0A1B385 | V1H945 |
| A0A0A1R5N6 | U1VBA4 | A0A0G2MMZ1 | A0A027YRP2 | UPI00016C8460 | A0A0F6B9B3 |
| A0A073VBC0 | UPI00066656EE | V1MAM1 | L3PWK5 | UPI000675DF85 | A0A0F7JES7 |
| I6FY95 | A0A0H3FP62 | B3YFM1 | S1GVU2 | A0A0E1LGB9 | UPI0005F937F6 |
| A0A0D7LIV8 | UPI0005014921 | A0A0H2WUN6 | M9K6A8 | D2ZMD4 | L0MA89 |
| X7I032 | UPI00063C446F | V1XNT7 | T9TBM0 | UPI0003ED146B | UPI0004B98CEC |
| D4BE43 | UPI0002CAC6D5 | A0A0H3S2Q8 | D7ZK11 | A0A0E2A5Z6 | E1I441 |
| UPI0001C3403D | UPI00026947D6 | X2KCL1 | L3NT10 | A0A0I2G829 | D8ADU8 |
| G5P1B6 | UPI0002B60DFC | A0A0H3IIW8 | H4K9Z1 | UPI0002C8DC1E | UPI0001FB4B2C |
| G5LGM2 | I6FIC1 | C0Q3C2 | S0VUG2 | UPI0006659C9 | D7XDB2 |
| A0A0H2VE91 | A0A073VVJ1 | V2NKZ3 | M2P544 | UPI0003EF3546 | UPI00050B0CB8 |
| Q1R4C1 | UPI0003F93F50 | A0A0H4VNJ1 | E3XW04 | UPI000370A2F0 | A0A0I0YDW9 |
| W8ZQE8 | L4IV51 | V7UEH9 | S0V315 | A0A0J0PQF7 | UPI0003FF3A54 |
| A0A024KJK2 | A0A0J8YSU2 | M4LQ08 | N2JTA5 | E6WHH6 | UPI00067E3DB0 |
| UPI00050B495A | UPI0002CAC228 | Q57HQ6 | H4IIM4 | UPI00057BE5A7 | UPI00050ABBE7 |
| A0A090ND62 | A0A0F0R0L1 | A0A089GCQ8 | A0A026RVL8 | UPI0003BF7FA1 | UPI00050BC0F6 |
| A0A024L7U7 | U2MK71 | S5HQI6 | E9XUJ2 | T8XXA5 | UPI0001FB4D65 |
| I0VX51 | UPI0005750034C | A0A0H3BQS9 | A0A017JGC0 | A0A0H0BBN2 | A0A0I2EFX3 |
| C9XT80 | UPI000282E630 | V1SQB1 | D6JHC8 | A0A0F3XJB2 | V6E727 |
| UPI0003027365 | UPI0005307602 | A0A0H3RDJ9 | T5ZU25 | A0A085PA08 | V0VKJ6 |
| K8BR96 | UPI0006A629C6 | V0GAX0 | Q8X8P5 | D6IG48 | UPI000589632A |
| W0AUM0 | UPI0006A6039B | A0A0F0IT73 | B1LLY4 | L4UZM9 | UPI0002A4D3B7 |
| UPI0002B9DE03 | UPI0002CC68E2 | A0A0D5WNL4 | R6TVJ8 | L3C1J2 | UPI000628182D |
| K8A0N1 | UPI0002CCA014 | A0A0F2ZMT8 | A0A0G3JMG2 | UPI0004D7F7DF | UPI00062757E2 |
| UPI0005196C1F | A0A0D5WY30 | A0A0G2NZ21 | D3QXA5 | UPI0006800C6C | UPI00053A6F37 |
| E3G3X3 | A0A0K0HFZ6 | V5ZRD0 | D3H4V1 | UPI0002CCBDA0 | UPI0005CEF8A7 |
| A0A0B5INH2 | UPI00056ED442 | V7IJT2 | A0A023Z641 | UPI0002CB0C5E | A0A0H7L7Z4 |
| UPI0006969E0D | UPI0002CA6A43 | V2D935 | C6EG01 | A0A0J1LKQ0 | A0A0I1QVM4 |
| A0A0J8ZBK9 | F1ZPQ8 | B5Q5I2 | B7UND0 | A0A0G2NT28 | UPI0004643C70 |
| UPI0002EE2722 | E9Z1A2 | V1RGT6 | L9HYA4 | V2PRV4 | A0A0I2RPB4 |
| A0A0J1RJH0 | I2REU8 | X4BR52 | A0A0H3PUC7 | UPI0002CBC0D7 | UPI000281D683 |
| A0A066P4B2 | UPI0005EA4E43 | UPI0004A8DEFA | A0A0F6GUU7 | B3HAV2 | A0A0I0V6U1 |
| F5S3C5 | UPI0003BCDF55 | G5P176 | Q3YVF3 | UPI00050A9E00 | W1WLH4 |
| A0A0E2M6M6 | UPI0002C935D9 | G9WCL2 | A0A0F6FES0 | UPI0004D4FB82 | UPI00069A9A9D |
| A0A0J0P9D3 | A0A090V7I4 | G5MAR0 | A0A0G3KBA3 | M8PMP0 | A0A0H7RCS5 |
| A0A0J0VSA8 | A0A089Q428 | UPI00067C89D7 | A0A0F6CBC7 | UPI000483DDB5 | UPI00050B3740 |
| A0A0J0QVP3 | UPI00039807B5 | UPI00067AC747 | J2YWY3 | A0A0D7ESI8 | W1ASV1 |
| A0A0J0LCW8 | UPI0004DA8D8C | UPI00069F6BC0 | B7LU43 | A0A0J0DP92 | W1DW14 |
| A0A0A6EFN1 | UPI0004635F02 | UPI0002A6DF22 | A0A025C616 | UPI000352C78C | J2X0N7 |
| A0A0F1A8N0 | UPI0004637008C | UPI00067D0E8D | A0A0H4S4M4 | G4C8R9 | G5LGM3 |
| A0A0F1HGJ1 | R9VNE2 | UPI00028DE27E | A0A0H2Z4N7 | UPI0005AA8C72 | UPI0002B9DB1F |
| A0A074TPI3 | UPI0002CC3EDA | UPI0005F857AB | F0JWA1 | UPI0002CC9A6F | X3YLW0 |
| A0A0J9AGF8 | UPI0002695288 | UPI0005797D3A | UPI0005EAF698 | UPI0005C674E6 | UPI0004381BCD |
| UPI000668E496 | UPI00034D611A | J5W6W9 | D7ZU66 | UPI0006658EEE | UPI0002AEB5B0 |
| A0A0J1SRM4 | M7RF80 | A0A0F1L5B3 | UPI000696EBE1 | A0A0J4TS24 | G5QS93 |
| A0A0H0ABS0 | K8AAR4 | UPI0006675A7B | UPI0006995D61 | A0A0C7L099 | G5MAU7 |
| A0A0J2H3P7 | A0A0I2D6J9 | E1J5X4 | UPI00053B46E6 | Z5CP12 | X3UNX0 |
| A0A0E2R9B6 | M8KEA1 | E6BNN4 | UPI0006881EBB3 | D3RH84 | B3PGX1 |
| UPI0004B58C5B | UPI000574FBCF | D7XMB5 | UPI0002C925C5 | B5XYK3 | UPI0002DB7E81 |
| A0A0J2FBS7 | UPI0002A1343F | A0A079F6E9 | B1ERG0 | UPI0005CC1957 | UPI0003B61D19 |
| A0A0J9AI33 | UPI000537C7CA | A0A071AVK4 | UPI0002CB7FF2 | UPI000666ABBF | UPI00037AE6F5 |
| A0A0J8Z8W7 | A0A0J8Y5W3 | A0A079FJR3 | A0A029K3W3 | R5WI88 | UPI00040A8AC5 |
| H3MDK3 | UPI000472771C | UPI0005AB1B13 | A0A029LTL0 | A0A089PHR7 | A1SQW8 |
| A0A0G3PTS1 | UPI0002B580C6 | UPI0002CBB03B | UPI000390DC2A | A0A0H3CV27 | G5QNH0 |
| A0A0I1EU55 | E8DEL4 | UPI00069C71E8 | S5N2R7 | A0A0H0C242 | G5S3E4 |
| UPI000669A104 | E7XIB6 | X5MS66 | G2S5G8 | A0A0F0TB45 | G5SJ34 |
| W0BDW4 | UPI0003915F4D | UPI000614634C | A0A0F2AUK2 | A0A071M1C1 | X3XE62 |
| G8LKV0 | UPI00038FA10B | UPI0005ED8E6D | A0A0J0JZA2 | UPI00035E9F50 | UPI000689139D |
| A0A0J0TK85 | A0A0F6TXR6 | V1GX81 | UPI0006769073 | F4W269 | G5R9I0 |
| A0A0J0GZG0 | UPI00037F6D42 | A0A0G3QEA8 | A0A090U681 | UPI00038FA53E | G5P3F2 |
| A0A0G4BNQ9 | UPI0006145584 | UPI000666A5AA | A0A023V4X1 | A0A0B7GI73 | UPI0003D2FA70 |
| A0A0I0T9Z3 | UPI0004DAE8E7 | UPI000315529E | A0A0I2BUS0 | A0A0G2MHY8 | A0A084CN62 |
| R4Y7F0 | A0A0J8XHN7 | A9MJ02 | R8WJE0 | A0A0H0DHS6 | UPI00068E1512 |
| C8T0H7 | UPI0003BECD47 | S1HNI3 | A0A0J0IRI6 | A0A0J0SSF2 | UPI0005D093A3 |
| F4VLD8 | H3N5H9 | UPI0003BB87D8 | A0A0F3YGX7 | A0A0J0B472 | A0A0H4R3L7 |
| F4SRL8 | K6KT52 | UPI000353E7DB | UPI0002CB932D | A0A0J0ENJ8 | A0A0B8UZ32 |
| F4NQE6 | A0A0H3ENI0 | A0A0F5B4P9 | S0UJP4 | A0A0H0DM28 | A0A0B8V3X1 |
| K8B2N0 | UPI0004D4C5A1 | UPI000250C01F | M8X9A7 | A0A0J0PB20 | U4TEK6 |
| UPI0003A800E6 | UPI000598DBB2 | N4NWV1 | | | |

TABLE 8

*D. radiodurans* UvrD and its Orthologs in Thermophilic Species

| Accession # | Entry name | Protein names | Organism | Gene name |
|---|---|---|---|---|
| Q9RTI9 | Q9RTI9_DEIRA | DNA helicase | *Deinococcus radiodurans* (strain ATCC 13939/DSM 20539/JCM 16871/LMG 4051/NBRC 15346/NCIMB 9279/R1/VKM B-1422) | DR_1775 |
| F0RMJ1 | F0RMJ1_DEIPM | DNA helicase | *Deinococcus proteolyticus* (strain ATCC 35074/DSM 20540/JCM 6276/NBRC 101906/NCIMB 13154/VKM Ac-1939/CCM 2703/MRP) | Deipr_0885 |
| H8GTP8 | H8GTP8_DEIGI | DNA helicase | *Deinococcus gobiensis* (strain DSM 21396/JCM 16679/CGMCC 1.7299/I-0) | uvrD2, DGo_CA1449 |
| C1CVA3 | C1CVA3_DEIDV | DNA helicase | *Deinococcus deserti* (strain VCD115/DSM 17065/LMG 22923) | uvrD, Deide_12100 |
| A0A016QL30 | A0A016QL30_9DEIO | DNA helicase | *Deinococcus phoenicis* | DEIPH_ctg079orf0093 |
| Q1J014 | Q1J014_DEIGD | DNA helicase | *Deinococcus geothermalis* (strain DSM 11300) | Dgeo_0868 |
| D3PR99 | D3PR99_MEIRD | DNA helicase | *Meiothermus ruber* (strain ATCC 35948/DSM 1279/VKM B-1258/21) (*Thermus ruber*) | K649_05745 |
| A0A0D0N7B7 | A0A0D0N7B7_MEIRU | DNA helicase | *Meiothermus ruber* | SY28_04645 |
| E8U932 | E8U932_DEIML | DNA helicase | *Deinococcus maricopensis* (strain DSM 21211/LMG 22137/NRRL B-23946/LB-34) | Deima_1926 |
| D7BGJ6 | D7BGJ6_MEISD | DNA helicase | *Meiothermus silvanus* (strain ATCC 700542/DSM 9946/VI-R2) (*Thermus silvanus*) | Mesil_1937 |
| A0A0A7KLI4 | A0A0A7KLI4_9DEIO | DNA helicase | *Deinococcus swuensis* | QR90_10300 |
| F2NK78 | F2NK78_MARHT | DNA helicase | *Marinithermus hydrothermalis* (strain DSM 14884/JCM 11576/T1) | Marky_1312 |
| A0A0F7JIM6 | A0A0F7JIM6_9DEIO | DNA helicase | '*Deinococcus soli*' Cha et al. 2014 | SY84_01165 |
| E4U8J8 | E4U8J8_OCEP5 | DNA helicase | *Oceanithermus profundus* (strain DSM 14977/NBRC 100410/VKM B-2274/506) | Ocepr_1221 |
| L0A7L7 | L0A7L7_DEIPD | DNA helicase | *Deinococcus peraridilitoris* (strain DSM 19664/LMG 22246/CIP 109416/KR-200) | Deipe_3622 |

TABLE 9

36 seed sequences of UvrD-like helicase group PF00580

| | | | | | |
|---|---|---|---|---|---|
| ADDA_BACSU | EX5B_MYCTU | O53348_MYCTU | PCRA_GEOSE | Q9ZJE1_HELPJ | UVRD_ECOLI |
| ADDA_LACLM | HMI1_YEAST | O66983_AQUAE | PCRA_MYCTU | REP_BUCAP | UVRD_HAEIN |
| EX5B_BORBU | O24736_THETH | O83140_TREPA | PCRA_STAA8 | REP_ECOLI | UVRD_MYCGE |
| EX5B_CHLTR | O25569_HELPY | O83991_TREPA | Q46538_DICNO | REP_HAEIN | UVRD_MYCPN |
| EX5B_ECOLI | O26611_METTH | O84614_CHLTR | Q9Z7D4_CHLPN | SRS2_SCHPO | UVRD_RICPR |
| EX5B_HAEIN | O51319_BORBU | P73465_SYNY3 | Q9ZCJ7_RICPR | SRS2_YEAST | Y340_MYCPN |

TABLE 10

Selected Low-Cysteine or No-Cysteine Wild-Type PcrA Helicases

PcrA with no cysteine from *L. citreum* MK20

```
/gene="pcrA"                        MSVETLTNGMNNKQAEAVQTTEGPLLIMAGAGSGKTR
/locus_tag="LCK_00476"              VLTHRIAHLVQDLNVFPWRILAITFTNKAAREMRERIAA
/EC_number="3.6.1.-"                LLSEDVARDIWVSTFHALAVRILRRDGEAIGLAKNFTIID
/note="COG0210L;                    TSAQRTLMKRVINDLNLDTNQYDPRTILGMISNAKNDM
TIGR01073"                          LRPRDYAKAADNAFQETVAEVYTAYQAELKRSQSVDF
/codon_start=1                      DDLIMLTIDLFQSAPEVLARYQQQFEYLHVDEYQDTND
/transl_table=11                    AQYTIVNLLAQRSKNLAVVDGAGQSIYGWRGANMMNI
/product="ATP-dependent             LNFEKDYPNAHTVMLEQNYRSTQNILDAANAVINHNNE
DNA helicase PcrA"                  RVPKKLWTENGKGDQITYYRAQTEHDEANFILSNIQQLR
/protein_id="ACA82309.1"            ETKHMAYSDFAVLYRTNAQSRNIEESLVKANMPYSMV
```

TABLE 10-continued

Selected Low-Cysteine or No-Cysteine Wild-Type PcrA Helicases

| | |
|---|---|
| /dh_xref="GI:169803691"<br>(SEQ ID NO: 53) | GGHKFYERKEILDIMAYMSLITNPDDNAAFERVVNEPKR<br>KFLTFAEMMHNLRQQSEFLNVTELTELVMTQSGYRQM<br>LAEKNDPDSQARLENLEEFLSVTKEFDDKYQPEDPESIDP<br>VTDFLGTTALMSDLDDFEEGDGAVTLMTLHAAKGLEFP<br>VVFLIGLEEGIFPLSRAMMDEDLLEEERRLAYVGITRAM<br>KKLFLTNAFSRLLYGRTQANEPSRFIAEISPELLETAYSGL<br>SRDKTQKKTLPFDRKMQRATATTYQATPVTKITNGVTG<br>GDQTSWSTGDKVSHKKWGVGTVISVSGRADDQELKVA<br>FPSEGVKQLLAAFAPIQKVD |

Selected Low Cysteine count thermophilic PcrA helicases

| | |
|---|---|
| >tr\|B5Y6N2\|B5Y6N2_COPPD<br>DNA helicase<br>OS = Coprothermobacter<br>proteolyticus (strain ATCC 35245/<br>DSM 5265/BT) GN = pcrA<br>PE = 4 SV = 1 (SEQ ID NO: 54) | MALPQENLIPPSPSHNHLTLSLRSHIGGFFIYNEDVDSVDL<br>SKLNEAQKQAVTAPPKPLAIIAGPGSGKTRVLTYRALFA<br>VKEWHLPPERILAITFTNKAADELKERLGRLIPEDGRIFA<br>ATMHSFAARMLRYFAPYAGISQNFVIYDDDDSKGLIEDI<br>LKQMNMDTKRFRPNDVLNHISAAKARMFDCNTFPEFIR<br>QRYGSWGYYFDTVHQVFMTYERLKEQSQALDFDDLIM<br>VLAQRMEDRPELREMIAGLFDLVMVDEFQDTNFAQYQ<br>MLLYMTNPHYSGMNNVTIVGDPDQSIYGFRAAEYYNIK<br>FRIDDYNPEVVFLDLNYRSNRTIVSDASALINDSPSALFE<br>RKLESIKGAGNKLILRRPFDDADAAITAAFEVQRLHKMG<br>IPYEEIAVLMRTRALTARVEREFATRNIQYHIIGGVFPF-<br>FAR<br>REIKDILAYLRLSRNAMDRVSLKRILTMKKRGFGTASLE<br>KLFNPAEENKLTLLEAMKAAVESLLFKKLSMNDYLESL<br>YTLIQTIQEIAEPSQAIYLVMEQENLLDHFRSISK-<br>SEEEYIE<br>RTENVKQLISIAEESADMDDFLQRSALGTRENNGGVEGV<br>AISTVHGVKGLEFQAVILYYVTDGFFPHSLSVTTAEKEEE<br>RRLLYVAMTRAKEHLIFYVPYKQPWGNGFEQMARPSPF<br>LRSIPKELWDGKPNEIESLYAPYSPQQKWSE |
| >tr\|E8MZN5\|E8MZN5_ANATU<br>DNA helicase OS = Anaerolinea<br>thermophila (strain DSM 14523/<br>JCM 11388/NBRC 100420/<br>UNI-1) GN = pcrA PE = 4 SV = 1<br>(SEQ ID NO: 55) | MDSLEHLNPQQRAAVTASAGPVLVLAGPGSGKTRVLTF<br>RIGYLLSQLGVAPHHILAVTFTNKAAREMQSRVEKLLGH<br>SLQGMWLGTFHAICARILRREQQYLPLDANFVIFDEDDQ<br>QALIKRALRDLNLDEKLYRPTSVHAAISNAKNNLILPED<br>YPTATYRDEVVARVYKRYQELLVSSNAVDFDDLLLYA<br>WKLLNEFSTVREQYARRFEHILVDEFQDTNLAQYELVK<br>LLASYHRNLFVVGDEDQSIYRWRGADYRNVLRFEEDFP<br>DRQKILLEQNYRSTQRVLDAAQAVINRNRNRTPKRLKST<br>PEHGEGEKLVLYEAVDDYGEAAFVVDTIQQLVAGGKA<br>RPGDFAIMYRTNAQSRLLEEAFLRAGVPYRLVGAMRFY<br>GRREVKDMIAYLRLVQNPADEASLGRVINVPPRGIGDKS<br>QLALQMEAQRTGRSAGLILMELGREGKDSPHWQALGR<br>NASLLADFGSLLGEWHRLKDEISLPSLFQRILNDLAYREY<br>IDDNTEEGQSRWENVQELLRIAYEEKGLTAFLENLAL<br>VSDQDTLPENVEAPTLLTLHAAKGLEFPIVFITGLDDGLIP<br>HNRSLDDPEAMAEERRLFYVGLTRAKKRVYLVRAAQR<br>STYGSFQDSIPSRFLKDIPADLIQQDGRGRRMGRSWQSES<br>RRSWDDNYAGTWGSRPERAKPSHAPILQPRFKPGMRVK<br>HPSWGEGLVVDSRIQDEDETVDIFFDSVGFKRVIASIANL<br>EILS |
| >tr\|E8PM35\|E8PM35_THESS<br>DNA helicase<br>OS = Thermusscotoductus<br>(strain ATCC 700910/<br>SA-01) GN = pcrA1 PE = 4 SV = 1<br>(SEQ ID NO: 56) | MQGPQSSHPGDELLRSLNEAQRQAVLHFEGPALVVAGA<br>GSGKTRTVVHRVAYLIAKRGVFPSEILAVTFTNKAAEEM<br>RERLKRMVKGGGELWVSTFHSAALRILRVYGERVGLKP<br>GFVVYDEDDQTALIKEVLKELGLAARPGPLKALLDRAK<br>NRGEAPESLLSELPDYYAGLSRGRLLDVLKRYEEALKA<br>QGALDFGDILLYALRLLEEDPEVLKRVRRRARFIHVDEY<br>QDTNPVQYRFTKLLAGEEANLMAVGDPDQGIYSFRAAD<br>IKNILEFTRDFPGAKVYRLEENYRSTEAILRFANALIVNN<br>ALRLEKTLRPVKPGGEPVRLYRARDARDEARFVAEEILR<br>LGPPPFDRVAVLYRTNAQSRLLEQTLASRGVPARVVGGV<br>GFFERAEVKDLLAYARLSLNPLDGVSLKRVLNTPPRGIG<br>PATVEKVEALAREKGLPLFEALRVAAEVLPRPALRHFL<br>ALMEELQELAFGPAEGFFRHLLEATDYPAYLREAYPED<br>YEDRLENVEELLRAAKEAEGLMEFLDKVALTARAEEPG<br>EPAGKVALMTLHNAKGLEFPVVFVVGVEEGLLPHRSSL<br>STLEGLEEERRLFYVGVTRAQERLYLSYAEEREVYGRTE<br>ATRPSRFLEEVEGGLYEEYDPYRASAKVSPSAPGEARA<br>SKPGAYRGGEKVIHPRFGQGTVVAAMGDEVTVHFEGV<br>GLKRLSLKYADLRPVG |
| >tr\|E8PL08\|E8PL08_THESS<br>DNA helicase<br>OS = Thermusscotoductus<br>(strain ATCC 700910/ | MLNPEQEAVANHFTGPALVIAGPGSGKTRTVVHRIARLI<br>RKGVDPETVTAVTFTKKAAGEMRERLVHLVGEETATK<br>VFTATFHSLAYHVLKDTGTVRVLPAEQARKLIGEILEDL<br>QAPKKLTAKVAQGAFSRVKNSGGGRRELIALYTDFSPYI |

TABLE 10-continued

Selected Low-Cysteine or No-Cysteine Wild-Type PcrA Helicases

```
SA-01) GN = pcrA2 PE = 4 SV = 1    ERAQDAYEAYKEEKRLLDFDDLLHQAVHELSTDIDLQA
(SEQ ID NO: 57)                    RWGHRARFLIVDEYQDTNLVQFNLLRLLLTPEENLMAV
                                   GDPNQAIYAWRGADFRLILEFKKHFPNATVYKLHTNYR
                                   SHNGIVTAAKKVITHNTQREDLDLKALRNGDLPTLVQA
                                   QSREDEALAVAEVVKRHLDQGTPPEEIAILLRSLAYSRPI
                                   EATLRRYRIPYTIVGGLSFWNRKEVQLYLHLLQAASGNP
                                   ESTVEVLASLVPGMGPKKARKALETGKYPKEAEEALQL
                                   LQDLRAYTGETGEHLASAVQNTLHRHRKTLWPYLLELA
                                   DGIEEAAWDRWANLEEAVSTLFAFAHHTPEGDLDTYLA
                                   DILLQEEDPEDSGDGVKIMTLHASKGLEFAVVLLPFLVE
                                   GAFPSWRSAQNPATLEEERRLFYVGLTRAKEHAYLSYH
                                   LVGERGATSPSRFARETPANLIHYNPTIGYQGKETDTLSK
                                   LAELF
```

Example 10. Cysteine Reactive Crosslinkers and Alternative Crosslinkers

Bis-maleimide crosslinkers with contour length varying from 6 to 25 Angstrom were used as exemplary crosslinkers (Table 2): BMPEG2, BMOE, BMH, DTME, (1,2-Phenylene-bis-maleimide), and (Succinyl Bis[(phenylimino)-2,1-ethanediyl]bis(3-maleimidopropanamide)). Alternatively bis-maleimide crosslinkers such as BMPEG3, BMB, BMDB, (1,4-Phenylene-bis-maleimide), (Bis-maleimidomethyl), and (N,N-[Dithiobis[(carbonylphenylimido)-2,1-ethanediyl]]bis(3-maleimidopropanamide)) or homobifunctional vinylsulfone crosslinker such as HBVS can be used. An alternative crosslinker can be of any crosslinker of desired length that fits the criteria set forth in Example 8 with suitable functional end groups. For crosslinking two cysteines, suitable end groups can be any of the maleimide, haloacetyl, iodoacetyl, pyridyl disulfide, vinylsulfone and other suitable moieties. Table 11 shows examples of bis-maleimide linkers with corresponding lengths.

TABLE 11

Selected Bismaleimide Crosslinkers

| Crosslinker | Spacer Arm Length (Å) | Spacer Arm Composition (between maleimide groups) |
|---|---|---|
| BMOE | 8.0 | Alkane |
| BMDB | 10.2 | Cis-diol (periodate cleavable) |
| BMB | 10.9 | Alkane |
| BMH | 13.0 | Alkane |
| DTME | 13.3 | Disulfide (reducing agent cleavable) |
| BM(PEG)2 | 14.7 | Polyethylene glycol (PEG) |
| BM(PEG)3 | 17.8 | Polyethylene glycol (PEG) |

Example 11. Alternative Crosslinking Methods to Cysteine Crosslinking

As an alternative to cysteine crosslinking chemistry, one can introduce a pair of unnatural amino acids for crosslinking with linkers using different chemistries as defined herein. This may be advantageous over cysteine engineering, because it may eliminate the extra steps of site directed mutagenesis of potentially interfering native cysteines and potentially detrimental effects of such mutations in other related helicases. For example, it was shown herein that in the PcrA helicase, there are two native cysteines that are highly conserved across diverse species (FIGS. 4A and 4B). The mutating out of these two cysteines in PcrA from *Bacillus stearothermophilus* reduced the ATPase activity by more than 80%. However replacing all five native cysteines in Rep from *E. coli* had a very minimal effect.

Alternatively, a target residue pair can be introduced, one of which is an unnatural amino acid and the other is a cysteine. Alternatively, one can introduce two or more pairs of target residues, preferably each pair can be specifically targeted with specific crosslinkers that employ orthogonal chemistries so that unwanted inter-pair crosslinking is avoided (for example, one pair of cysteines and one pair of unnatural amino acid residues) for enhanced conformational stability and activity.

Example 12. Unnatural Amino Acids as an Alternative to Cysteine Crosslinking There are nearly one hundred unnatural amino acids (Uaa) that have been genetically incorporated into recombinant or endogenous proteins. These Uaa provide a wide spectrum of side chains that can be covalently crosslinked using a homo or hetero bi-functional linker with suitable end groups. Additionally a multi-branched multi- or homo-functional crosslinkers can be used for secondary conjugation other chemicals, biomolecules such as a DNA polymerase enzyme, in addition to the main crosslinking reaction. Uaa can incorporate specific reactive groups to the specific sites on the proteins, such as aryl iodides, boronic acids, alkynes, azides, or others, or they can be post-transcriptionally or chemically modified to prepare for desired crosslinking chemistry. Examples of Uaa include, but are not limited to, homopropargylglycine, homoallylglycine, azido-phenylalanine, azidohomoalanine and others. Uaa modification and crosslinking reactions include, but are not limited to, azides and cyclooctynes in copper-free click chemistry, nitrones and cyclooctynes, oxime/hydrazone formation from aldehydes and ketones, tetrazine ligation, isonitrile based click reaction, quaricyclane ligations, copper-catalyzed azide-alkyne 1,3-dipolar cycloaddition, copper acetylide to activate terminal alkynes toward reaction with azides, Staudinger ligation, cyclooctyne reactions, and Huisgen cycloaddition. Suitable end groups of these crosslinkers would include, but are not limited to, azide, alkyne, succinimide, phosphine, etc.

Example 13. Selected Super-Family 1B (SF1B) and Super-Family 2 (SF2) Helicases Selected SF1B and SF2 helicases are described herein. In an embodiment, the helicase is RecD2. In an embodiment, the RecD2 helicase is from *D. radiodurans*. Selected target residue pairs for crosslinking and the specific distances between the pairs, in RecD2 are shown in FIG. 12 and Table 12.

TABLE 12

Selected Crosslinking Pairs for 5' to 3' SF1B Superhelicase RecD2

| RecD2 | | Backbone C—C distance in Å |
|---|---|---|
| ALA632 | ILE170 | 18.0 |
| ALA632 | ASN171 | 17.0 |
| PHE635 | GLY200 | 18.0 |

| 1B domain amino acid (RecD2; D. radiodurans) | 2B domain amino acid (RecD2; D. radiodurans) | Backbone C—C distance in Å |
|---|---|---|
| ARG 410 (B-sheet) | ASN 596 (loop) | 12.91 |
| PRO 413 (B-sheet) | PHE 603 (loop) | 13.04 |
| GLN 414 (B-sheet) | ASN 596 (loop) | 11.13 |
| GLY 415 (loop) | GLU 601 (loop) | 8.38 |
| PHE 416 (loop) | ARG 417 (loop) | 6.36 |
| ARG 417 (loop) | ASN 599 (loop) | 12.43 |
| GLY 418 | TYR 598 (loop) | 11.00 |
| LEU 411 (B-sheet) | PHE 603 (loop) | 13.62 |
| ARG 417 (loop) | ARG 417 (loop) | 10.14 |

RecQ helicase has a winged helix domain (denoted by WH, shown in green in FIG. 13 and FIG. 14) that rotates 90 degrees and makes contact with the duplex in the unwinding conformation (Mathei et al., "Structural mechanisms of DNA binding and unwinding in bacterial RecQ helicases" Proc Natl Acad Sci USA. 2015 Apr. 7; 112(14):4292-7). In an embodiment, stabilization of the WH domain of RecQ leads to superhelicase activation. Stabilization of the closed form of the WH domain can be achieved by crosslinking it to the catalytic core using the residue pairs shown in Table 13.

TABLE 13

Selected Crosslinking Pairs for Superhelicase RecQ

| Catalytic domain | WH domain | Backbone C—C distance in Å |
|---|---|---|
| PHE221 | VAL470 | 7.91 |
| GLU219 | ARG514 | 5.61 |
| LYS212 | GLU467 | 8.90 |
| PHE221 | GLU467 | 6.52 |

RecQ1 helicase also has a winged helix domain (denoted by WH, shown in green in FIG. 15) that rotates 90 degrees and makes contact with the duplex in the unwinding conformation. In an embodiment, stabilization of the WH domain of RecQ1 leads to superhelicase activation. Stabilization of the closed form of the WH domain can be achieved by crosslinking it to the catalytic core using the residue pairs shown in Table 14.

TABLE 14

Selected Crosslinking Pairs for Superhelicase RecQ1

| Zinc finger alpha helix domain amino acid | WH beta hairpin domain amino acid | Backbone C—C distance in Å |
|---|---|---|
| MET429 | TYR564 | 12.17 |
| VAL431 | THR566 | 8.31 |
| MET429 | ALA565 | 8.77 |
| MET429 | THR566 | 7.10 |

5'-3' SF1 superhelicase T4 Dda (FIG. 16) is known to unwind dsDNA as a monomer, and has sequence similarity to E. coli recD (exonuclease V). In an embodiment, stabilization of the tower/hook and pin domains leads to superhelicase activation. Stabilization of the closed form of the tower/hook and pin domains can be achieved by crosslinking them using the residue pairs shown in Table 15. Wild-type T4 Dda has 439 amino acids, a 5'-3' unwinding polarity, and 5 cysteines. It is a DNA helicase that stimulates DNA replication and recombination reactions in vitro, and has been suggested to play a role in the initiation of T4 DNA replication in vivo. It acts by dissociating and associating with the DNA molecule being unwound, interacting with UvsX and binding tightly to the gene 32 protein. Selected crosslinking pairs that parallel SF1A helicases are located in the tower/hook and the pin domains based on the crystal structure (FIG. 16) and are listed in Table 15.

TABLE 15

Selected Crosslinking Pairs for Superhelicase T4 Dda

| 1B domain (pin) amino acid | 2B domain (tower/hook) amino acid | Backbone C—C distance in Å |
|---|---|---|
| THR 91 (B-sheet) | TRP 374 (Alpha helix) | 9.77 |
| TYR 92 (B-sheet) | TYR 363 (Alpha helix) | 11.78 |
| TYR 92 (B-sheet) | TYR 363 (Alpha helix) | 11.73 |
| TYR 92 (B-sheet) | LYS 364 (Alpha helix) | 10.42 |
| GLU 93 (loop) | LYS 364 (Alpha helix) | 6.83 |
| GLU 93 (loop) | ALA 372 (loop) | 9.25 |
| GLU 93 (loop) | PRO 373 (loop) | 10.45 |
| GLU 93 (loop) | SER 375 (Alpha helix) | 10.38 |
| GLU 94 (loop) | TRP 374 (Alpha helix) | 8.25 |
| GLU 94 (loop) | ALA 372 (Alpha helix) | 8.25 |
| GLU 94 (loop) | SER 375 (Alpha helix) | 10.73 |
| GLU 94 (loop) | TRP 378 (Alpha helix) | 8.58 |
| VAL 96 (B-sheet) | LYS 381 (Alpha helix) | 12.55 |
| VAL 96 (B-sheet) | TRP 374 (Alpha helix) | 12.36 |
| VAL 96 (B-sheet) | TRP 378 (Alpha helix) | 10.56 |

Structural data have been Obtained for the SF1B RNA helicase Upf1 (5'-3' SF1B RNA/DNA helicase) in complexes with phosphate, ADP and the non-hydrolysable ATP analogue, ADPNP (Cheng et al, 2006), although a structure with bound RNA remains lacking. These structures reveal a conformational change that accompanies binding of ATP and which is very similar to that which occurs during catalysis in SF1A helicases such as PcrA.

Example 14. Identifying Suitable Crosslinking Sites for Immobilizing 2B Domain at a Particular Rotational Conformation Between the Open and Closed Form It has been shown herein that the closed and open forms captured in the crystal structures are the active and the inactive states of the Rep helicase, respectively, which can be interconverted by a 133 degree rotation of the 2B domain around an axis. Therefore, the active conformation can be defined through definition of the range of a rotational angle, θ (theta), relative to the closed form with θ=0 (FIG. 17). For example, in an embodiment, Rep-X becomes a superhelicase if θ<40 degrees. In addition, arresting the helicase in an intermediate conformation, such as, e.g. θ=40 degrees, may allow a new function. While immobilizing the 2B domain at an angle θ=40 degrees, it was found that residue pairs distances increase more than 10 Å when θ changes from 40 degrees to 0 degrees (to closed form), and increase more than 20 Å when θ changes from 40 degrees to 130 degrees (to open form). Positions of residues at the desired θ, can be interpolated from open and closed form crystal structures via rigid body rotation of the 2B domain around an axis. Having performed this calculation for θ=40 degrees of Rep helicase, it was found that 2B residues that satisfy this criteria are residues 515 and 518-525, and the residues on the rest of the protein structure satisfying the criteria are residues 543-547. For example, crosslinking residues 521 to residue 547 on with a crosslinker with a length of about 10 Å, restricts the 2B domain to a conformation of θ=40 degrees. Similar to restricting the 2B conformation to θ=0 degrees (closed form), corresponding residues to restrict in helicases with unknown structures can be determined via sequence alignment.

Rigid body rotation of the 2B domain around a chosen axis can convert the closed form to the open form or vice versa. In the case of *E. coli* Rep, the chosen axis intersects the alpha carbons of residue ILE371 and residue SER280 or residue ALA603. In an embodiment, the chosen axis intersects the alpha carbons of residue ILE371 and residue SER280. Theta is the angle of rotation around this chosen axis from the closed form toward the open form. According to this definition, theta is 0 degrees for the closed form. In the case of *E. coli* Rep, theta increases to 133 degrees when it is rotated around the chosen axis to obtain the open form. Theta for the open form may vary between different helicases.

Thus, in an embodiment of a modified helicase described herein, the first amino acid and second amino acid, together with an axis vector defined by an alpha carbon of ILE371, from which the vector originates, and an alpha carbon of SER280 or an alpha carbon of ALA603 of *E. coli* Rep helicase, define an angle, theta, wherein theta is about 355 degrees to about 25 degrees in an active conformation. In an embodiment, theta is about 355 degrees, about 0 degrees, about 5 degrees, about 10 degrees, about 15 degrees, about 20 degrees or about 25 degrees, or any increment or point between about 355 degrees to about 25 degrees. In another embodiment, theta is about 0 degrees in an active conformation. In an embodiment, theta is about 60 degrees to about 155 degrees in an inactive conformation. In an embodiment, theta is about 60 degrees, about 65 degrees, about 70 degrees, about 75 degrees, about 80 degrees, about 85 degrees, about 90 degrees, about 95 degrees, about 100 degrees, about 105 degrees, about 110 degrees, about 115 degrees, about 120 degrees, about 125 degrees, about 130 degrees, about 133 degrees, about 135 degrees, about 140 degrees, about 145 degrees, about 150 degrees, or about 155 degrees, or any increment or point between about 60 degrees to about 155 degrees. In another embodiment, theta is about 133 degrees in an inactive conformation. In an embodiment, the axis vector is defined by an alpha carbon of ILE371 and an alpha carbon of SER280 of *E. coli* Rep helicase. In another embodiment, the axis vector is defined by an alpha carbon of ILE 371 and an alpha carbon of SER280 of *E. coli* Rep helicase.

Example 15. Examples of Thermophilic Orthologs/Homologs of UvrD, Rep and PcrA

Based on the crosslinking target site selection criteria established in Example 8, and analogous to identification of suitable crosslinking sites in hologous helicases as described in Example 9, by sequence alignment and structural homology modeling, the corresponding crosslinking target residues are identified in helicases with unknown structures. Subsequently these helicases can be converted to superhelicase forms. Thus, in an embodiment, Rep-like thermophilic helicases featuring low or no cysteine content, and homologs or orthologs thereof are also suitable candidates for cross-linking to form a thermophilic superhelicase. Selected examples of thermophilic orthologs or homologs of UvrD, Rep and PcrA are shown in Tables 16-18. In certain exemplary embodiments, a suitable UvrD, Rep or PcrA helicase is selected from the following species: *Thermococcus* sp. EXT9, *Thermococcus* sp. IRI48, *Thermococcus* sp. IRI33, *Thermococcus* sp. AMT7, *Thermococcus nautili*, *Thermococcus onnurineus* (strain NA1), *Thermococcus kodakarensis* (strain ATCC BAA-918/JCM 12380/KOD1) (*Pyrococcus kodakaraensis* (strain KOD1)), *Thermococcus sibiricus* (strain MM 739/DSM 12597), *Thermococcus paralvinellae*, *Thermus aquaticus* Y51MC23, *Thermus aquaticus* Y51MC23, *Thermus aquaticus* Y51MC23, *Thermus* sp. RL, *Thermus* sp. RL, *Thermus* sp. 2.9, *Salinisphaera hydrothermalis* C41B8, *Thermus filiformis*, *Meiothermus ruber*, *Thermus* sp. NMX2.A1, *Thermus thermophilus* JL-18, *Thermus scotoductus* (strain ATCC 700910/SA-01), *Thermus scotoductus* (strain ATCC 700910/SA-01), *Oceanithermus profundus* (strain DSM 14977/NBRC 100410/VKM B-2274/506), *Oceanithermus profundus* (strain DSM 14977/NBRC 100410/VKM B-2274/506), *Oceanithermus profundus* (strain DSM 14977/NBRC 100410/VKM B-2274/506), *Oceanithermus profundus* (strain DSM 14977/NBRC 100410/VKM B-2274/506), *Oceanithermus profundus* (strain DSM 14977/NBRC 100410/VKM B-2274/506), *Thermus oshimai* JL-2, *Thermus oshimai* JL-2, *Thermus oshimai* JL-2, *Thermomonospora curvata* (strain ATCC 19995/DSM 43183/JCM 3096/NUMB 10081), *Thermodesulfatator indicus* (strain DSM 15286/JCM 11887/CIR29812), *Geobacillus stearothermophilus* (*Bacillus stearothermophilus*), *Coprothermobacter proteolyticus* (strain ATCC 35245/DSM 5265/BT), *Meiothermus silvanus* (strain ATCC 700542/DSM 9946/VI-R2) (*Thermus silvanus*), *Anaerolinea thermophila* (strain DSM 14523/JCM 11388/NBRC 100420/UNI-1), *Thermoanaerobacterium thermosaccharolyticum* M0795, *Meiothermus ruber* (strain ATCC 35948/DSM 1279/VKM B-1258/21) (*Thermus ruber*), *Meiothermus ruber* (strain ATCC 35948/DSM 1279/VKM B-1258/21) (*Thermus ruber*), *Deinococcus radiodurans* (strain ATCC 13939/DSM 20539/JCM 16871/LMG 4051/NBRC 15346/NCIMB 9279/R1/VKMB-1422), *Thermodesulfobium narugense* DSM 14796, *Thermus thermophilus* (strain HB8/ATCC 27634/DSM 579), *Dictyoglomus thermophilum* (strain ATCC 35947/DSM 3960/H-6-42), *Thermus thermophilus* (strain SG0.5JP17-16), *Thermus thermophilus* (strain SG0.5JP17-16), *Thermus thermophilus* (strain SG0.5JP17-16), *Thermus* sp. CCB_US3_UF1, *Deinococcus geothermalis* (strain DSM 11300), *Thermus thermophilus* (strain HB27/ATCC BAA-163/DSM 7039), *Thermus thermophilus* (strain HB27/ATCC BAA-163/DSM 7039), *Marinithermus hydrothermalis* (strain DSM 14884/JCM 11576/T1).

TABLE 16

| Entry (3D) | Entry name | Protein names | Organism | Length | Gene names (primary)/Gene encoded by |
|---|---|---|---|---|---|
| L0B9N8 | L0B9N8_9EURY | UvrD Rep helicase SFI | *Thermococcus* sp. EXT9 | 591 | Plasmid pEXT9a |
| L0B9J0 | L0B9J0_9EURY | UvrD Rep helicase SFI | *Thermococcus* sp. IRI48 | 547 | Plasmid pIRI48 |
| L0BAD9 | L0BAD9_9EURY | UvrD Rep helicase SFI | *Thermococcus* sp. IRI33 | 591 | Plasmid pIRI33 |
| L0BAT5 | L0BAT5_9EURY | UvrD Rep helicase | *Thermococcus* sp. AMT7 | 591 | Plasmid pAMT7 |
| W8NUG2 | W8NUG2_9EURY | Superfamily I DNA and RNA helicase and helicase subunits | *Thermococcus nautili* | 665 | |
| B6YXQ7 | B6YXQ7_THEON | UvrD/REP helicase | *Thermococcus onnurineus* (strain NA1) | 533 | |
| Q5JFK3 | Q5JFK3_THEKO | DNA helicase, UvrD/REP family | *Thermococcus kodakarensis* (strain ATCC BAA-918/JCM 12380/ KOD1) (*Pyrococcus kodakaraensis* (strain KOD1)) | 661 | |
| C6A075 | C6A075_THESM | DNA helicase, UvrD/REP family | *Thermococcus sibiricus* (strain MM 739/DSM 12597) | 716 | |
| W0I5I1 | W0I5I1_9EURY | DNA helicase, UvrD/REP family protein | *Thermococcus paralvinellae* | 659 | |
| B7AA42 | B7AA42_THEAQ | DNA helicase (EC 3.6.4.12) | *Thermus aquaticus* Y51MC23 | 701 | |
| B7A5I6 | B7A5I6_THEAQ | DNA helicase (EC 3.6.4.12) | *Thermus aquaticus* Y51MC23 | 868 | |
| B7A954 | B7A954_THEAQ | DNA helicase (EC 3.6.4.12) | *Thermus aquaticus* Y51MC23 | 542 | |
| H7GEQ7 | H7GEQ7_9DEIN | DNA helicase (EC 3.6.4.12) | *Thermus* sp. RL | 1030 | |
| H7GH69 | H7GH69_9DEIN | DNA helicase (EC 3.6.4.12) | *Thermus* sp. RL | 693 | |
| A0A0B0SAG4 | A0A0B0SAG4_9DEIN | DNA helicase (EC 3.6.4.12) | *Thermus* sp. 2.9 | 692 | |
| A0A084IL47 | A0A084IL47_9GAMM | ATP-dependent DNA helicase Rep (EC 3.6.4.12) | *Salinisphaera hydrothermalis* C41B8 | 670 | rep |
| A0A0A2WMV1 | A0A0A2WMV1_THEFI | DNA helicase (EC 3.6.4.12) | *Thermus filiformis* | 665 | |
| A0A0D0N7B7 | A0A0D0N7B7_MEIRU | DNA helicase (EC 3.6.4.12) | *Meiothermus ruber* | 706 | |
| W2U4X3 | W2U4X3_9DEIN | DNA helicase (EC 3.6.4.12) | *Thermus* sp. NMX2.A1 | 710 | |
| H9ZQB5 | H9ZQB5_THETH | DNA helicase (EC 3.6.4.12) | *Thermus thermophilus* JL-18 | 693 | |
| E8PM35 | E8PM35_THESS | DNA helicase (EC 3.6.4.12) | *Thermus scotoductus* (strain ATCC 700910/SA-01) | 708 | pcrA1 |
| E8PL08 | E8PL08_THESS | DNA helicase (EC 3.6.4.12) | *Thermus scotoductus* (strain ATCC 700910/SA-01 | 621 | pcrA2 |
| E4U8J8 | E4U8J8_OCEP5 | DNA helicase (EC 3.6.4.12) | *Oceanithermus profundus* (strain DSM 14977/ NBRC 100410/ VKM B-2274/ 506) | 719 | |

TABLE 16-continued

| Entry (3D) | Entry name | Protein names | Organism | Length | Gene names (primary)/Gene encoded by |
|---|---|---|---|---|---|
| E4U4N5 | E4U4N5_OCEP5 | DNA helicase (EC 3.6.4.12) | *Oceanithermus profundus* (strain DSM 14977/ NBRC 100410/ VKM B-2274/ 506) | 917 | |
| E4UAI1 | E4UAI1_OCEP5 | DNA helicase (EC 3.6.4.12) | *Oceanithermus profundus* (strain DSM 14977/ NBRC 100410/ VKM B-2274/ 506) | 889 | Plasmid pOCEPR01 |
| E4UAI8 | E4UAI8_OCEP5 | DNA helicase (EC 3.6.4.12) | *Oceanithermus profundus* (strain DSM 14977/ NBRC 100410/ VKM B-2274/ 506) | 638 | Plasmid pOCEPR01 |
| E4UAI4 | E4UAI4_OCEP5 | AAA ATPase | *Oceanithermus profundus* (strain DSM 14977/ NBRC 100410/ VKM B-2274/ 506) | 606 | Plasmid pOCEPR01 |
| K7QW32 | K7QW32_THEOS | DNA helicase (EC 3.6.4.12) | *Thermus oshimai* JL-2 | 693 | |
| K7QWX5 | K7QWX5_THEOS | DNA helicase (EC 3.6.4.12) | *Thermus oshimai* JL-2 | 694 | Plasmid pTHEOS01 |
| K7QTS9 | K7QTS9_THEOS | DNA helicase (EC 3.6.4.12) | *Thermus oshimai* JL-2 | 854 | |
| D1AF88 | D1AF88_THECD | DNA helicase (EC 3.6.4.12) | *Thermomonospora curvata* (strain ATCC 19995/ DSM 43183/ JCM 3096/ NCIMB 10081) | 799 | |
| F8A884 | F8A884_THEID | DNA helicase (EC 3.6.4.12) | *Thermodesulfatator indicus* (strain DSM 15286/ JCM 11887/ CIR29812) | 503 | |
| A0A087LEB0 | A0A087LEB0_GEOSE | Uncharacterized protein | *Geobacillus stearothermophilus* (*Bacillus stearothermophilus*) | 807 | |
| B5Y6N2 | B5Y6N2_COPPD | DNA helicase (EC 3.6.4.12) | *Coprothermobacter proteolyticus* (strain ATCC 35245/DSM 5265/BT) | 696 | pcrA |
| D7BJL0 | D7BJL0_MEISD | DNA helicase (EC 3.6.4.12) | *Meiothermus silvanus* (strain ATCC 700542/ DSM 9946/VI-R2) (*Thermus silvanus*) | 646 | Plasmid pMESIL02 |
| E8MZN5 | E8MZN5_ANATU | DNA helicase (EC 3.6.4.12) | *Anaerolinea thermophila* (strain DSM 14523/JCM 11388/NBRC 100420/UNI-1) | 737 | pcrA |
| L0INW7 | L0INW7_THETR | ATP-dependent exoDNAse (Exonuclease V), alpha subunit/ helicase superfamily I member | *Thermoanaerobacterium thermosaccharolyticum* M0795 | 769 | Plasmid pTHETHE01 |

TABLE 16-continued

| Entry (3D) | Entry name | Protein names | Organism | Length | Gene names (primary)/Gene encoded by |
|---|---|---|---|---|---|
| D3PR99 | D3PR99_MEIRD | DNA helicase (EC 3.6.4.12) | Meiothermus ruber (strain ATCC 35948/ DSM 1279/VKM B-1258/21) (Thermus ruber) | 706 | |
| D3PLL2 | D3PLL2_MEIRD | DNA helicase (EC 3.6.4.12) | Meiothermus ruber (strain ATCC 35948/ DSM 1279/VKM B-1258/21) (Thermus ruber) | 920 | |
| Q9RTI9 (X-ray crystallography (3)) | Q9RTI9_DEIRA | DNA helicase (EC 3.6.4.12) | Deinococcus radiodurans (strain ATCC 13939/DSM 20539/JCM 16871/LMG 4051/NBRC 15346/NCIMB 9279/R1/VKM B-1422) | 745 | |
| M1E5C5 | M1E5C5_9FIRM | DNA helicase (EC 3.6.4.12) | Thermodesulfobium narugense DSM 14796 | 610 | |
| Q5SIE7 | Q5SIE7_THET8 | DNA helicase (EC 3.6.4.12) | Thermus thermophilus (strain HB8/ ATCC 27634/ DSM 579) | 692 | |
| B5YD55 | B5YD55_DICT6 | DNA helicase (EC 3.6.4.12) | Dictyoglomus thermophilum (strain ATCC 35947/DSM 3960/H-6-12) | 656 | |
| F6DJA4 | F6DJA4_THETG | DNA helicase (EC 3.6.4.12) | Thermus thermophilus (strain SG0.5JP17-16) | 722 | Plasmid pTHTHE1601 |
| F6DIL2 | F6DIL2_THETG | DNA helicase (EC 3.6.4.12) | Thermus thermophilus (strain SG0.5JP17-16) | 692 | |
| F6DJ67 | F6DJ67_THETG | DNA helicase (EC 3.6.4.12) | Thermus thermophilus (strain SG0.5JP17-16) | 1014 | Plasmid pTHTHE1601 |
| G8N9P8 | G8N9P8_9DEIN | DNA helicase (EC 3.6.4.12) | Thermus sp. CCB_US3_UF1 | 704 | |
| Q1J014 | Q1J014_DEIGD | DNA helicase (EC 3.6.4.12) | Deinococcus geothermalis (strain DSM 11300) | 741 | |
| Q745W4 | Q745W4_THET2 | DNA helicase (EC 3.6.4.12) | Thermus thermophilus (strain HB27/ ATCC BAA-163/ DSM 7039) | 551 | Plasmid pTT27 |
| Q72IS0 | Q72IS0_THET2 | DNA helicase (EC 3.6.4.12) | Thermus thermophilus (strain HB27/ ATCC BAA-163/ DSM 7039) | 692 | uvrD |
| F2NK78 | F2NK78_MARHT | DNA helicase (EC 3.6.4.12) | Marinithermus hydrothermalis (strain DSM 14884/JCM 11576/T1) | 716 | |

TABLE 17

| Entry | Sequence | SEQ ID NO: |
|---|---|---|
| L0B9N8 | MSEALPVTSFEFSLPEESVIKIYGPPGTGKTTTLVRIIEHLIGEHDHTEFLESYGLSLLFGQYGAEDV IFMTFQTSALKEFEARTGIKVKDRQNKPGRYYSTVHGIAFRLLIDSGAIDGVITQNFGSLSPEDW FRLFCRQNGLRFESSEMGYSNVFNDGNRLWNALTWAYNVYYPTKGPKARHEALKRLAPKL WKYPPLWEEYKTEKGILDYNDMLVKAYEGLKSGEIDPRNLPGHKYSPKVLIVDEFQDLSPLQFE IFRLLANYMDLVIIAGDDDQTIFSYQGADPRLMNYVPGREIVLSKRSYRLPIVVQAKAMTVISKTR HRKEKTVAPRTDLGDFKYKLFWFPDFLNDLVREAQEGHSIFILVRTNRQVLKLGKELILAGVHF RHLKVDYRSIWEAGSKEWGTFRDLVQALLKARRGEELEIADLVTILYYSELIDWHLGEKLPEKER YKKIAEQMEKTIEAIEKGLMPFDILKVKDDPFSVLDLEKIESLSPRHGKVAVELIREIMKEKSQVV SVPRDAEIYLDTLHASKGREADVVFLINDLPRKWSSILKTREELDAERRVWYVGLTRARKKVYLL NGKHPFPVL | 58 |
| L0B9J0 | MRVKIYGPPGTGKTTTLQRTIDYTLGNSSEPPIPLPESFPTDLEPKNLAFVSFTNTAIDVIGKRTGI TTRSKEAPYMRTIHGLILSVLAEHFDPVAVDNLGKLADIQAEFSMRMGYYYSKDPFEFAEGN MKFNVITRALELYLPKTGDVEEALKLIDNREDRKFALAWYRKRQKKIMDFDDILVIGYEHLEDF YVPVEVAFIDEGQDNGPLDYILLEKGFEGAKFVFLAGDPLQSIYGFKGADPRLFVRWKADKEIIL PRSYRLPKKVWLLSQSWALSLGIKGAVVRYAPSEKLGRVSRMKFIEALSYAVEQAKRGRSVLIL ARTNSLVKFVGNILSIEFGVAYGHLKRASYWESHLLKFIEGLQMLKLWDGVFPIKVQDTKPITGL IRKLKDKHAREVLRRWRDSRQWSLEVQAVLQRIKKNPSEYFYITDFDRQALKAYFSKARLDLTE ELIIDTIHAAKGEEADVVIFLDFIPTRSEERINPEELQEKLVAYVGFTRAREELIIVPTPAIKYHPMR DFMGVRQILGVVNFHKHLLIKELVGGL | 59 |
| L0BAD9 | MSEALPVTSFEFSLPRERIIKLYGAPGTGKTTTLVKIIEHLIGFQDHTEFLENYGINLPFGQYEPGE VIFMTFQTSALKEFEARTGIKVKDRQNKPGRYYSTVHGIAFRLLIDSGAVDGLITQNFGSLSPED WFRNFCRQNGLRFESSEMGYSNVFNEGNQLWNALTWAYNVYYPTKGPKARYEALKRLAPK LWKFPPLWEEYKKGRGILDYNDMLVRAYEGLRSGEIDPRNLPGHKYSPKVLIVDEFQDLSPLQ FEIFRLANHMDLVIIAGDDDQTIFSYQGADPRLMNYVPGLEWLRKSHRLPIVVQAKALTVISK TRHRKEKTVAPRTDLGDFKYKLFWFPDFLNDLVREAQEGHSIFILVRTNRQVLKLGKELILAGV HFEHLKVDYRSIWEAGSKEWGTFRDLVQALLKAKRGEELEVADLVTILYYSELIDWHLGEGISE KERYKKIAEQMEKTIEAIEKGLMPFDVLRVKENPFSVLDLEKIESLSPRHGKVAVELIKELMKEKS QVVSIPKDARIYLDTLHASKGREADVVFLINDLPRKWSSILKTREELDAERRVWYVGLTRARKK VYLLNGKHPFPVL | 60 |
| L0BAT5 | MSEALSITSFDFTLPRERIIKIYGPPGTGKTTTLVRIIEHLIGFQDHTEFLENYGLSLPFGQYGAEDV IFMTFQTSALKEFEARTGIKVKDRQNKPGRYYSTVHGIAFRLLIDSGAVDGLITQNFGSLSPED WFRHFCRQNGLRFESSEMGYSNIFNEGNQLWNALTWAYNVYYPTKGPKARYEALKRLAPKL WKFPPLWEEYKKEKGILDYNDMLIRAYEGLKSGEIDPRNLPGHKYSPKVLIVDEFQDLSPLQFEI FRLLANHMDLVIIAGDDDQTIFSYQGADPRLMNYVPGREIVLSKSYRLPIVVQAKALTVISKTRH RKEKTVAPRTDLGDFKYKLFWFPDFLNDLVREAQEGHSIFILVRTNRQVLKLGKELILAGVHFEH LKVDYRSIWEAGSKEWGTERDLVQALLKAKKGEELEVADLVTILYYSELIDWHLGERISEKERYK KIAEQMEKTIEAIEKGLMPFDILKVKENPFSVLDLEKIESLSPRHGKVAVELIKELMKEKSQVVSIP KDAKIYLDTLHASKGREADVVFLINDLPRKWSNILKTREELDAERRVWYVGLTRARKKVYLLNG KHPFPIL | 61 |
| W8NUG2 | MNENEKLSKFIAKLKVLIEMERKAEIEAMRAEMRRLSGREREKVGRAVLGLNGKVIGEELGYFL VRYGREREIKTEISVGDLVVISKRDPLKSDLVGTVVEKGKRFITVALETVPEWALKSVRIDLYAND ITFKRWLENLENLRESGRRALELYLGLREPEGGEEVEFTPFDKSLNASQRRAIAKALGSPDFFLIH GPFGTGKTRTLVELIRQEVARGNRVLATAESNVAVDNLVERLVDSGLKVVRVGHPSRVSRGLH ETTLAYLMTQHELYGELRELRVIGENLKEKRDTFTKPAPKYRRGLTDRQILRLAEKGIGTRGVPA RLIREMAQWLKINEQVQKTFDDARKLEERIAREIIREADVVLTTNSSAGLEVVDYGSYDVAIIDE ATQQATIPSVLIPINRAGREVLAGDHKQLPPTILSEKAKELSKTLFEGLIERYPGKSEMLTVQYRMN ERLMEFPSREFYDGRIEADESIRRITLADLGVKSPEDGDAWAEVLKPENVLVFIDTARREDRFER QRYGSESRENPLEARLVKEAVEGLLRLGVKAEWIGVITPYDDQRDLISSLLPEEIEVKTVDGYQG REKEVIVLSFVRSNRKGELGFLKDLRRLNVSLTRAKRKLILIGDSSTLSSHPTYRRLVEFVRERETV VDAKRLIGKVKIK | 62 |
| B6YXQ7 | MTAPIPTTYSILGVAGAGKTTQLIDLLNYLNFENSRNEKIWERHFEPVELNRIAFISFSNTAIQEIA NRTGIEIKARKKSAPGRYFRTVTGLAEVLLYENNLMTFEEVRSVSKLEGFRIKWAREHGMYYKP RDNDISYSGNEFFAEYSRLVNTYYHVKSLSEIIEMHSKSHLLLDYIREKEKLGIVDYEDILMRAYDY RNDIVVDLEYMIIDEAQDNSLLDYATLLPIAKNNATELVLAGDDAQLIYDFRGANYKLEHKLIER SEIILNLTETRRFGSEIANLATAIIDDMNYIQKREVLSAATHSTKVAHIDLFQMMSILQNMATTD LTVYILARTNAVLNYVAKVLDEYKIQYKKNERITDFDRFLLSLNRLMRNEYTNDDIYTIYNYLRNK VAREEELKERLFQHKLHWTEKDVLGILLLLAYEQTTAKRILTTAKNTNFKIKLSTIHSAKGSEADVV ELINSVPHKTKMKILENYEGEKRVLYVAVTRARKFLFIVDQPVARRYEQLYYIRSYESRAQGSLV NRVAVPVA | 63 |
| Q5JFK3 | MNEKEVLLSKFIAHLKELVEMERRAEIEAMRLEMRRLSGREREKVGRAVLGLNGKVIGEELGYF LVRYGRDREIKTEISVGDLVVISKRDPLKSDLVGTVVEKGKRFLTVAIETVPEWALKGVRIDLYAN DITFKRWMENLDNLRESGRKALELYLGLREPEESEPVEFQPFDKSLNASQRGAIAKALGSGDFF LVHGPFGTGKTRTLVELIRQEVARGHKVLATAESNVAVDNIVERLADSGLKVVRIGHPSRVSKA LHETTLAYLITQHDLYAELRELRVIGENLKEKRDTFTKPAPKYRRGLSDREILRLAEKGIGTRGVPA RLIREMAEWIRINQQVQKTFDDARKLEERIAREIIQEADVVLTTNASAGLEVVDYGEYDVAVID EATQATIPSVLIPINRAKREVLAGDHKQLPPTILSEKAKELSKTLFEGLIERYPEKSEMLTVQYRM NERLMEFPSREFYDGKIKAHESVKNITLADLGVSEPEFGNFWDEALKPENVLVFIDTSKREDRF ERQRRGSDSRENPLEAKLVTETVEKLLEMGVKPDWIGVITPYDDQRDLISSMVGEDIEVKTVD GYQGREKEIIVLSFVRSNRRGELGFLTDLRRLNVSLTRAKRKLIAVGDSSTLSNHPTYRRFIEFVRE RGTFIEIDGKKH | 64 |

TABLE 17 -continued

| Entry | Sequence | SEQ ID NO: |
|---|---|---|
| C6A075 | MTRVQIPAGAPKYGPVAQPGQSARLISGRSGVRSPAGPPKALLKERFRELFIHKNPVITMHVK NYIAKLVDLVELEREAEIEAMREEMRRLKGYEREKVGRAILNLNGKIIGEEFGFKLVKYGRKEAF KTEIGVGDLVVISKGNPLASDLVGTVVEKGSRFIVVALETVPSWAFRNVRIDLYANDITFRRQLE NLKKLSESGIRALKLILGKETPLKSSPEEFTPFDRNLNQSQKEAVSYALGSEDFFLIHGPFGTGKTR TLVELIVQEVKRGNKILATAESNVAVDNLVERLWGKVKLVRLGHPSRVSVHLKESTLAFQVESH ERYRKVRELRNKAERLAVMRDQYKKPTPQMRRGLTNNQILKLAYRGRGSRGVPAKDIKQMA QWITLNEQIQKLYKFAEKIESEIIQEIIEDVDVVLSTNSSAALEFIKDAEFDVAIIDEASQATIPSVLIP IAKARREVLAGDHKQLPPTILSEEARALSETLFEKLIELYPFKAKMLEIQYRMNQLLMEFPSREFY NGKIKADGSVKDITLADLKVREPPFGEPWDSILKREEPLIFVDTSNRTDKWERQRKGSTSRENP LEALLVREIVERLLRMGIKKEWIGIITPYDDQVDSIRSIIQDDEIEIHTVDGYQGREKEIIILSLVRSN KKGELGFLMDLRRLNVSITRAKRKLVVIGDSETLVNHEYKRLIHFVKKYGRYIELGDTGIN | 65 |
| W01511 | MNLIRYINHLKELVELEREAEIEAMREEMRKLTGYEREKVGRAVLGLNGKIIGEEFGYKLVKYGR KQEIKTEISVGDLVVISKGNPLASDLIGTVTEKGKRFLVVALETVPSWALRNVRIDLYANDITFKR QIENLDKLSESGKRALRFILGLEKPKESIDIEFKPFDEQLNESQKKAVGLALGSEDFFLIHGPFGTG KTRTVAEVILQEVKRGKKVLATAESNVADNLVERLWGKVKLVRLGHPSRVSKHLKESTLAYQ VEIHEKYKRVREFRNKAERLAMLRDQYTKPTPQWRRGLTDRQILRLAEKGIGARGIPARVIKS MAQWITFNEKVQRLYNEAKKIEEEIVKEIIRQADVVLSSAALEFIKDIKFIDVAVIDEASQATI PSVLIPIAKANKFILAGDHKQLPPTILSEEEAKELSETLFEKLIELYPSKAKMLEIQYRMNERLMEFPS KEFYNGKIKAYDGVKNITLLDLGVRVFSFGEPWDSILNKEPLVFVDTSKHPEKWERQRKGSLS RENLLEAELVKEIVQKLLRMGIKPESIGVITPYDDQRDLISLLLENDEIEVKTVDGYQGREKEVIILS FVRSNKKGELGFLTDLRRLNVSLTRAKRKLIAIGDSETLSAHPIYKRFVEFVKEKGIFVQLNQYVS QTS | 66 |
| B7AA42 | MGEAHPSEEALLSSLNEAQRQAVLHFEGPALVVAGAGSGKTRTVVHRVAYLIARRGVFPSEIL AVTFTNKHAAEEMKARLKAMVRGAGELWVSTFHAAALRILRVYGERVGLKPGFVVYDEDDQT ALLKEVLKELGLAAKPGPIKSLLDRAKNQGVPPEHLLLELPEFYAGLSRGRLQDVLHRYQEALRA QGALDFGDILLYALKLLEEDGEVLKRVRKRARFIHVDEYQDTNPVQYRFTRLLAGEEANLMAV GDPDQGIYSFRAADIRNILDFTQDYPKARVYRLEDNYRSTEAILRFANAVIVKNALRLEKTLRPV KKGGEPVRLFRAESARDEAREVAEEIARLGPPFDPRARVVLYRTNAQSRLLEQALASRGIPARVVG GVGFFERAEVKDLLAYARLSLNPLDAVSLKRVLNTPPRGIGPATVEKVQAIARERGLPLFEALKV AALTLPRPEPLRAFLALMEELMDLAFGPAEAFFRHLLLATDYPAYLKEAYPEDAEDRLENVEELL RRAAKEASLMDFLDKVALTARAEEPAEAEGRVALMTLHNAKGLEFPVVFLVGVEEGLPHRSS LSTQEGLEEERRLFYVGVTRAQERLYLSYAQEREIYGRLEPVRPSRFLEEVDEGLYEVYDPYRQSS RKPTPPPHRALPGAFRGGEKWEIPRFGPGTVVAAAGDEVTVHFEGVGLKRLSLKYADLRPA | 67 |
| B7A5I6 | MRVYLASAGTGKTHALVEELKGLIQSGVPLRRIAALTFTRKAAEELRGRAKRAVLALSAEDPRLK EAEREVHGALFTTIHGEMAEALRFITAPLLSLDPDFALLDTFLAEALFLEEARSLLYRKGLDGGLA RALLHLYRKRTLAETLHPLPGAEGVFALYLEALEGYRRRLPAELSPSDLEALALRILENPEALRVV ERFPHILLDEYQDTGPLQGRFFQGLKEAGARLVWGDPKQSIYLERNARVEVEREALKQAEEVR YLSTTYRHAQAVAEFLNRFTALFGEEGVRVRPHRQEVGRVEVHWVVGEGGLEEKRRAEAHLL LDRLMALREEGYAFSQMAVLVRSRSSLPPLEAAFRARGVPYALGRGRSFFARPEVRDLYHALR LSLLEGPPGPEERLALLAFLRGPWVGLDLSEVEEALKAQDPILLPEAVRAKLRALRALGALPPLE ALKRLSRDEAFLRRLSPRARVNLDALLLLAAMERFPDLEALLEWLRLRAEDPEAAELPEGEEGV QVLTVHGAKGLEWPWALFDLSRGENPKEEDLLVGLGGEVALRGTPAYKEVRKALRKAQAEE ARRLLYVALSRARDVLIVTGSASGRPGPWVEALERLGLGPESQDPLVRRHPFKALPPLGDRPQ TPPPPPLPAPYAHLAFPERPLPFVYSPSAFTKAKEPVPLAEALEKEALPEFYRALGTLVHYAIARH LDPEDEGAMAGLLLQEVAFPFAEGEKRRLLEEVRDLLRRYGMLGPSLPPLEAREEDHAELPLV LPLGGTVWYGILDRLYRVGGRWYLEDYKTDREVRPEAYREQLAIYRRALLEAWGVEAEARLVY LRHGLVHPLDPEELERALKEGFPGMGPEGGGEKA | 68 |
| B7A954 | MKGLTGSSRLRVYGPPGTGKTTWLKNEVERLLRSGVPGEEIAVCAFSRAAFREFASRLAGQVP EENLGTIHSLAYRAIGRPPLALTKDALSDWNRRVPDTWRVTPRVDGRGADLLDVMDPYEDE DSRPPGDKLYDRVAYLRNTLAPMAAWSEEERAFFQAWKSWMNAKGLVDEPGMLEAALAK PGGLGARFLLVDEAQDLTPLQLLLVEKWAQGARLALVGDDDQAIYGFMGADGASFLGVPVE DELVLGQSYRVPARVQRVAEAVIRRVQNRAPKRYAPRGDEGEVRLLWVPPEDPYHAWDAL ERVNRGESVLFLATAKYLLEELKRELLRVGEPYANPYAPHRHSFNLFPQGARSAWEKARSFLFP NRIAADVKAWTKHVSSKVFAVKGEEARRYIESFPDEEKVGDDHPIWNVFRPEHRPHAVGRD VSWLLDHLLGNAPKTMRQSLMVALKSPEAVLQGRARVWIGTIHSVKGGEADWVYVWPGY TRKAAREHPDQLHRLFYVAATRARKGLVLMDQGKAPHGYVWPRVDEFWGEVWV | 69 |
| H7GEQ7 | MEANLYVAGAGTKTYTLAERYLGFLEEGLSPLQVVAVTFTERAALELRHRVRQMVGERSLG HKERVLAELEAAPIGTLHALAARVCREFPEEAGVPADFQVMEDLEAALLLEAWLEEALLEALQ DPRYAPLVEAVGYEGLLDTLREVAKDPLAARELLEKGLGEVAKALRLEAWRXLRRRMEELFHG ERPEERYPGFPKGWRXEEPEVVPDLLAWAGEVKFNKKPWLEYKXDPALXRLLKLLGGVKEGES PGPADERLEEVWPLLRELAEGVLARLEERRFRARRLGYADLEVHALRALEXEEVRAYYRGRERR LLVDEFQDTNPVQVRLLQALFPDLRAWTVVGDPNQSIYSFRRADPKVMERFQXEAAKEGLRV RRLEKSHRYHQGLADFHNRFFPPLLPGYGAVSAERKPEGEGPWVFHFQGDLEAQARFIAQEV GRLLSEGFQWDLGEKAYRPMSLRDVAVLGRTWRDLARVAEALRRLEVPAVEAGGGNLLETR AFKDAYLALRFLGDPXDEEALVGLLRSPFFALTDGEVRRLAEARGEGETLWEVLEREGDLSAEA ERARETLRGLLRRKALEAPSRLLQRLDGATGYTGVAARLPQGRRRVKDWEGTLDLVRKLEVGS EDPFLVARHLRLLLRSGLSVERPPLEAGEAVTLLTVHGAKGLEWPVVEVLNVGGWNRLGSWK NNKTKPLFRPGLALVPPLVDEXGNPSALFHLKRRVEEEKQENRLLYVAATRASERLYLLLSP DLSPDKGDLDPQTLIGAGSLEKGLEATEPERPWSGEEGEVEVLEERIQGLPLEALPVSLLPLAAR DPEAARRLLGEPXEGGEAWXPXXPQETEEEVPGGAGVGRMTHALLERFEAXEDLEREGRA FLEESFPGAEGEEVEEAALRLARTFLTAEVFAPYRGNAVAKEVPVALELLGVRLEGRADRVGED | 70 |

TABLE 17 -continued

| Entry | Sequence | SEQ ID NO: |
|---|---|---|
| | WVLDYKTDRGVDAXAYLLQVGVYALALGKPRALVADLREGKLYEGASQQVEEKAEEVLRRLM<br>GGEGQGRQPYPLAATDPGHGAPG | |
| H7GH69 | MSDALLAPLNEAQRQAVLHFEGPALVVAGAGSGKTRIVVHRVAYLVARRGVEPSEILAVTFT<br>NKAAEEMRERLRGLVPGAGEVWVSTFHAAALRILRVYGERVGLRPGFVVYDEDDQTALLKEV<br>LKELALSARPGPIKALLDRAKNRGVGLKALLGELPEYYAGLSRGRLGDVLVRYQEALKAQGALD<br>FGDILLYALRLLEEDEEVLRLVRKRARFIHVDEYQDTSPVQYRFTRLLAGEEANLMAVGDPDQG<br>IYSFRAADIKNILDFTRDYPEARVYRLEENYRSTEAILRXANAVIVKNALRLEKALRPVKRGGEPV<br>RLYRAEDAREEAREVAEEIARLGPPWDRYAVLYRTNAQSRLLEQALAGRGIPARVVGGVGFFE<br>RAEVKDLLAYARLALNPLDAVSLKRVLNTPPRGIGPATWARVQLLAQEKGLPPWEALKEAART<br>FXRAEPLRHEVALVEELQDLVEGPAEAFFRHLLEATDYPTYLREAYPEDAEDRLENVEELLRAAK<br>EAEDLQDFLDRVALTAKAEEPAEAEGKVALMTLHNAKGLEFPVVELVGVEEGLLPHRNSLSTLE<br>GLEEERRLFYVGITRAQERLYLSHAEEREVYGRREPARPSRFLEEVEEGLYEVYDPYRXPKPXPPP<br>HRPRPGAFRGGERVVHPREGPGTVVAAQGDEVTVHFEGXGLKRLSLKYAELXPA | 71 |
| A0A0B0SAG4 | MDEALLSSLNEAQRQAVLHFQGPALVVAGAGSGKTRTVVHRVAYLIAHRGVYPTEILAVTFTN<br>KAAEEMRERLKGMVRGAGEVWVSTFHAAALRILRVYGERVGLKPGFVVYDEDDQTALLKEV<br>LKELGLSAKPGPIKALLDRAKNRGEPPEALLAELPEYYAGLSRRRLLDVFFRYQEALKAQGALDF<br>GDILLYALRLLEEDQEVLARVRKRARFIHVDEYQDTNPVQYRFTKLLAGEEANLMAVGDPDQG<br>IYSFRAADIKNILQFTADFPGAKVYRLEENYRSTEAILRFANAVIVKNALRLEKTLRPVKRGGEPV<br>RLFRAKDAREEARFVAEEILRLGPPFDRIAVLYRTNAQSRLLEQALAGRGVGARVVGGVGFFER<br>AEVKDLLAYARLALNPLDSVSLKRILNTPPRGIGPAIVEKVARLAQEKGLPLFEALKRAELLPRPE<br>PVRHFVALMEELMDLAFGPAEAFFRHLLQATDYPAYLREAYPEDHEDRLENVEELLRAAKEAE<br>SLLDFLDKVALTARAEEPAGAEGKVELMTLHNAKGLEPPWELVGVEEGLLPHRNSLNTLEALE<br>EERRLFYVGVTRAQERLYLSYAEEREVYGRLEATRPSRFLEEVEEGLYQEYDPYRSPRPVPPSHR<br>PKPGAFKGGEKVVHPREGPGTVVAASGDEVTVHFEGVGLKRLSLKYADLRPA | 72 |
| A0A084IL47 | MALPKLNPQQDAAMRYLDGPLLVLAGAGSGKTGVITRKIAHLIARGYDARRVVAVTFTNKAA<br>REMKQRASKLISADDARGLTVSTFHSLGLQMIREEHAALGYKPRFSIFDSEDADKVLADLVGR<br>DGDHRKATKAAISNWKSALIDPETATAQATGSDIPLARAYGEYQMRLLAGARAAFTVVGDDDQSIYAWR<br>GARPGNIADLSRDFPHLKVIKLEQNYRSVGNVLSAANQLIGASNQRAYEKTLWSAMGPGDRV<br>RVIAAPDEAGEAERIASEISSHKLRLGTAYGDYAILYRGNFQSRAFEKALRERDIPYRVSGGRSFF<br>ERSEIRDLVTYLKLMVNPDDDAAFLRIVNLPRREIGPATLEALGRYAGSRHISLFDAARGIGLAG<br>GVGERSGRRLADFVDWLRNLTQDSEGMTPRELVSQLIVDIDYRNWLRDTSANTKAARKRIEN<br>LDDPIGWLDRLDNAEDGKPVTLEDVVRRLSLMDFANQSEKDVENQVHLLTLHAAKGLEFDH<br>VFLAGLEEGMLPHHACLEDDKIEEERRLLYVGITRARKTLALTYARKRRRGGEESDSVPSRFLEEL<br>PADELDWPSATGTRSKAANAEQGRDQVAALRAMLGASADS | 73 |
| A0A0A2WMV1 | MPQVGFTDHFFKGLEALSREEQNRVREAVFAFMQDPKHPSFKLHRLEDIKTDRFWSARVSK<br>DLRLILYHHPEMGWIFAYVGHHDDAYRWAETHQAEVHPKLGLLQIFRWEEVRVEPRKIKPLL<br>PDYPDDYLLDLGVPPSYLKPLRLVETEDQLLGLIEGLPQDVQERLLDIAAGRPVTLPPKLAPSEE<br>WFKHPLSRQHIHFIQNLDELRQALSYPWERWMVFLHPAQREAVERVFQGPARVTGPAGTG<br>KTVVALHRAAALARRYPEEPLLLTTFNRFLASRLRSGLQRLLGEVPPNLTVENLHSLARRLHEQH<br>VGPVKLVKEEDYGPWLLEAAQGLEYGKNFLLSEFAFADAWGLYTWEAYRGFPRTGRGVPLTA<br>RERLKLFGAFQKVWGRMENEGALTENGLLHRLRQRAEEGALPRFRAVVVDEAQDLGPAELLL<br>VRALAQEAPDSLFFALDPAQRIYKSPLSWQALGLEVRGRSIRLKVNYRTTREIAKRAEAVLPKEV<br>EGEMREVLSLLQGPEPEIRGFPTQEACQAELVRWLRWLLEQGVRPEEVAVLARVRKLAEGLA<br>EGLRRAGIPVVLLSDQEDPGEGVRLGTVHSAKGLEFRAVALFGANRGLFPLESLLREAPSEADR<br>EALLAQERNLLYVAMSRARERWVGYWDEGSPFLTP | 74 |
| A0A0D0N7B7 | MSDLLSSLNPSQREAVLHFEGPALVVAGASGKTRTVVHRIAYLLRERRVYPAEILAVTFTNKA<br>AGEMKERLEKMVGRSARDLWVTTFHAAAVRILRTYGEYVGLKPGFVIYDEDDQNTLLKEVLK<br>ELELEAKPGPFRSMIDRIKNRGAGLAEYMREAPDFIGGVPRDVAAEVYRRYQNSLRMQGALD<br>FNDLLLLTIELFEQHPEVLHKVQQRARFIHVDEYQDTNPVMVVGDPDQ<br>SIYGFRNADINNILDFTKDYPGARVIRLEENYRSSSSILRVANAVIEKNALRLEKVLRPTKPGGEPV<br>RLYRAPNAREEAAFVAREIVKLGGYQQVAVLYRTNAQSRLLEEHLRRANVPVRLVGAVGFFER<br>REIKDLLAYGRVAVNPDDSINLRRIVNTPPRGIGATTVARLVEHAQKTGITVFEAFRAAEQVISR<br>PQQVQAFVRLLDELMEAAPFESGPTAFFQRVLEQTGFREALKQEPDGEDRLQNVEELLRAAQD<br>WEEEEGGSLADDFLDSVALTAKAEEPQGGDAPVEATLMTLHNAKGLEFPTVFLVGLEENLLPHR<br>NSLHRLEDLEEEERRLFYVGITRAQERLYLSYAEERETYGKREYTRPSRFLQDIPQDLLKEVGAFGD<br>GETRVLSQARPEPKPRTQPAEFKGGEKVKHPKFGSGTVVAAMGGEVTVMFPGVGLKRLAVK<br>FAGLERLE | 75 |
| W2U4X3 | MQGPQSSHPGDELLRSLNEAQRQAVLHFEGPALVVAGAGSGKTRTVVHRVAYLIAKRGVFPS<br>EILAVTFTNKAALEMRERLKRMVKGAGELWVSTFHSAALRILRVYGERVGLKPGFVVYDEDD<br>QTALIKEVLKELGLAARPGPLKALLDRAKNRGEAPESLLSELPDYYAGLSRGRLLDVLKRYEEALK<br>AQGALDFGDILLYALRLLEEDPEVLKRVRRRARFIHVDEYQDTNPVQYRFTKLLAGEEANLMA<br>VGDPDQGIYSFRAADIKNILEFTRDFPGAKVYRLEENYRSTEAILRFANALIVNNALRLEKTLRPV<br>KPGGEPVRLYRARDARDEARFVAEEILRLGPPFDRVAVLYRTNAQSRLLEQALASRGVPARVV<br>GGVGFFERAEVKDLLAYARLSLNPLDGVSLKRVLNTPPRGIGPATVEKVEALAREKGLPLFEALR<br>VAAEVLPRPAPLRHFLALMEELQELAFGPAEGFFRHLLEATDYPAYLREAYPEDHEDRLENVE<br>LLRMKEAEGLMEFLDKVALTARAEEPGEPAGKVALMTLHNAKGLEFPVVFVVGVEEGLLPHR<br>SSLSTLEGLEEERRLFYVGVTRAQERLYLSYAEEREVYGRTEATRPSRFLEEVEGGLYEEYDPYRA<br>SAKVSPSPAPSEARASKPKPGAYRGGEKVIHPRFGQGTVVAAMGDEVTVHFEGVGLKRLSLK<br>YADLRPVG | 76 |

TABLE 17 -continued

| Entry | Sequence | SEQ ID NO: |
|---|---|---|
| H9ZQB5 | MSDALLAPLNEAQRQAVLHFEGPALVVAGAGSGKTRTVVHRVAYLVARRGVEPSEILAVTFT NKAAEEMRERLRGLVPGAGEVWVSTFHAAALRILRVYGERVGLRPGFVVYDEDDQTALLKEV LKELALSARPGPIKALLDRAKNRGVGLEALLGELPEYYAGLSRGRLADVLRYQEALKAQGALD FGDILLYALRLLKEDEEVLRLVRKRARFIHVDEYQDTSPVQYRFTRLLAGEEANLMAVGDPDQG IYSFRAADIKNILDFTRDYPEARVYRLEENYRSTEAILRLANAVIVKNALRLEKALRPVKRGGEPV RLYRAEDAREEARFVAEEIARLGPPWDRYAVLYRTNAQSRLLEQALAGRGIPARVVGGVGFFE RAEVKDLLAYARLALNPLDAVSLKRVLNTPPRGIGPATWARVQLLAQEKGLPPWEALKEAART SSRVEPLRHEVALVEELQDLVEGPAEAFFRHLLEATDYPTYLREAYPEDAEDRLENVEELLRAAK EAEDLQDFLDKVALTAKAEEPAEAEGKVALMTLHNAKGLEFPVVFLVGVEEGLLPHRNSLSTLE GLEEERRLFYVGITRAQERLYLSHAEEREVYGRREPARPSRFLEEVEEGLYEVYDPYRVPKPAPPP HRPRPGAFRGGERVVHPRFGPGTVVAAQGDEVTVHFEGFGLKRLSLKYAELRPA | 77 |
| E8PM35 | MQGPQSSHPGDELLRSLNEAQRQAVLHFEGPALVVAGAGSGKTRTVVHRVAYLIAKRGVFPS EILAVTFTNKAAEEMRERLKRMVKGGGELWVSTFHSAALRILRVYGERVGLRPGFVVYDEDD QTALIKEVLKELGLAARPGPLKALLDRAKNRGEAPESLLSELPDYYAGLSRGRLLDVLKRYEEALK AQGALDFGDILLYALRLLEEDPEVLKRVRRRARFIHVDEYQDTNPVQYRFTKLLAGEEANLMA VGDPDQGIYSFRAADIKNILEFTRDFPGAKVYRLEENYRSTEAILRFANALIVNNALRLEKTLRPV KPGGEPVRLYRARDARDEAREVAEEILRLGPPFDRVAPVLVRTNAQSRLLEQTLASRGVPARVV GGVGFFERAEVKDLLAYARLSLNPLDGVSLKRVLNTPPRGIGPATVEKVEALAREKGLPLFEALR VAAEVLPRPAPLRHFLALMEELQELAFGPAEGFERHLLEATDYPAYLREAYPEDYEDRLENVEE LLRAAKEAEGLMEFLDKVALTARAEEPGEPAGKVALMTLHNAKGLEFPWFWGVEEGLLPHR SSLSTLEGLEEERRLFYVGVTRAQERLYLSYAEEREVYGRTEATRPSRFLEEVEGGLYEEYDPYRA SAKVSPSPAPGEARASKPGAYRGGEKVIHPREGQGWVAAMGDEVTVHFEGVGLKRLSLKYA DLRPVG | 78 |
| E8PL08 | MLNPEQEAVANHFTGPALVIAGPGSGKTRTVVHRIARLIRKGVDPETVTAVTFTKKAAGEMR ERLVHLVGEETATKVETATFHSLAYHVLKDTGTVRVLPAEQARKLIGEILEDLQAPKKLTAKVAQ GAFSRVKNSGGGRRELIALYTDFSPYIERAWDAYEAYKEEKRLLDFDDDLLHQAVHELSTDIDLQ ARWQHRARFLIVDEYQDTNLVQFNLLRLLLTPEENLMAVGDPNQAIYAWRGADFRLILEFKK HFPNATVYKLHTNYRSHNGIVTAAKKVITHNTQREDLDLKALRNGDLPTLVQAQSREDEALAV AEVVKRHLDQGTPPEEIAILLRSLAYSRPIEATLRRYRIPYTIVGGLSEWNRKEVQLYLHLLQAAS GNPESTVEVLASLVPGMGPKKARKALETGKYPKEAEEALQLLQDLRAYTGERGEHLASAVQN TLHRHRKTLWPYLLELADGIEEAAWDRWANLEEAVSTLFAFAHHTPEGDLDTYLADILLQEED PEDSGDGVKIMTLHASKGLEFAVVLLPFLVEGAFPSWRSAQNPATLEEEERRLFYVGLTRAKEH AYLSYHLVGERGATSPSRFARETPANLIHYNPTIGYQGKETDTLSKLAELF | 79 |
| E4U8J8 | MSARDLLSSLNEQQQAAVQHFLGPALVIAGAGSGKTRTVVHRVAYLLAEREVYPAEVLAVTFT NKAAGEMRERLSRMVGRAAGELVVVSTFHSASLRILRRYGERIGLKPGFVVYDDDDQRVLLKE VLGSLGLEARPTYVRAVLDRIKNRMWSVDEFLAHADDWVGGLTKQQMAEVYARYQQRLAE NNAVDFNDLLLRTIELFERHPEALEAVRQRARFIHVDEYQDTNPAQYRLTKLLAGDEANLMVV GDPDQSIYGERNADIQNILGFERDYRGAVVYRLEANYRSTAAILRVANALIERNQQRLEKTLRP VKPAGEPVRLYRAPDHREEAAFVAREVARLAGERALDDFAVLYRTNAQSRVLEEAFRRLNLPA RIVGGVGFYERREVKDVLAYARLAVNPADDVALRRVINVPARGVGAASVGKLAAWAQAQG VSLLEEAAHRAGELLAARQAAVAKFTDLLTTLREAAEGTGPEAFLRLVLAETGYSEMLRREGDS EPRLENLEELLRAAAEWEEEHGGSVAEFLDEIALTARAEEPNAAPEKSVTLMTLHNAKGLEFPV VFWGVEEGLLPHRSSLGSDAEIEEERRLLYVGITRAQERLYLTLSEERETWGQRERVRPSRFLEE IPEDFLKPVGPFGDAHEPAPAPLSSAPVNRAAKGSASGRIGGEKVRHPRYGEGTVVATSGEG ARQEVTVHFAEAGLKRLLVKYAGLERIE | 80 |
| E4U4N5 | MKVRIASAGTGKTYALTSRFTAALAEHPPYRLAAVTFTRSAAAELKARLRERLLAIAAGREQPSG AEDVPPEAVVRRAGALATEVLGATVTTIHGFFAELLRQNALALGLEPDFLRIDASESQQIFABEA RAYVYLNEEDDALAEVLGRLFAKRSLAAELRPQGEAAAEALWAHFRAVLERYARRLGGEALGPA DIELHAWRLLERAGREEALAARIRSRLARVEVDEYQDTSPLQGRVFAALEALGVEVEVVGDPK QSIYAFRNADVEVEREAMRRGEPLPPLVTSWRHDRALVRFLNRYVDWVAEERRPEAFARAEA PPVEARPDAGPGRVRLQLVQGEARQDALRPYEADQLARWLQERHAEHAWRDMAVLVRSH SSVPLLVRALAAHGLPHVVVGGRGFYDLIEVRDLVHAARVALDPRGRFSLAAFLRGPFAGLDL GRVERVLAAEDPLAELERAAPEVAERVDRLVRWVQTLRPLDFFERMVRTPFLEGASYLERLEP PARANVDQLLFKLASRRYGRLEFLLRDLEDLRGSDEAGVPEGGFDAVRIYTMHGSKGLEWPV VAVPDLNRGQPDGAEPFYVRPGSGEFAAEGDPDYPRFAAEWKERERQEAYRLLYVALSRPRS RLLLSLSVQLKPDGEGLRPKEWRRTLGRTLIEEMNLAAWDALEVERLDAARLPAPKAAAAAPR RAADVDERLRAPVEPLARPPWSPSALKAERPAPPELDDEGDVAVELEEPGVDPGLVARTVGIL VHYAIGQDWGPERLQDLWNQEAVQRLTEPERTRVKTEVAQRLETYWRLLGTELPALDERDE DYAEFPLLLPTRTARLDIVWEGVIDRLYRVGDVWVLEDYKTDRELHPERYHFQLALYRRAVAA AWGIEPEARLVYLRFGEVVPLEAQLLEEAFERGTREAEEV | 81 |
| E4UAI1 | MKVIVASAGTGKTTRLTQRYLEHLEQHPPQRVAAVTFTNKAAAELRERIFEALGRGSFYDFTPS PALAERLADYQVRVLEAPIGTIHSFFGYLLRLTAPMLGLDPHFEVIDPATARAWFLEEVRNLAIIE GAEVDETVTTALVELFKRRSISEAFEGTGDASRSLVAGRFKKVYARWLTRLGGRYLDPSEIERRAL ALIRHPEALERVRSRLGVVLVDEYQDTAPIQARVFEALEEAGVPIEVVGDPKQSIYAFRDADVE GFREAHRRARENGNVETLTVSYRHPPALADFLNAFTSAEAALGKAFTAEEEAPEVKPGREGDAR VELITVTPGDGKATLDALRNGEARLLARELRRLHDEEGYDYGQMLVLFRRRHQLPPLLRALRG AGLPFAVVGLRGLYEEPEVRELYHALRLATGEAPRDSLAVFLSGQPGGLTLGQVREVLAQDAPE SYLTLHHPEAAERLLRLRADAEKMRPEAELTRLIEAPTAKGPPFLDLLELEMADTVLYVLGRIEH TRTYPEAVATLESFRSGGEEASLARLGGDAVRVMSAHAAKGLQAPVVVIFDADRTFNGNSD ELVIEPRTGRVALNGEDAYESIAQALKARKEGEDHRLIYVALSRSSERLIVSAAVKEPRKGSWLH HLTEVLNLGSKFEHRNVTLAEIALEEPIEQEAATLPVDPELATPLPPAPPAVSSPTALKAERELEV PDPEEAWPADPEARLLGRIVGILVHEGIQRDWDPDDPEVLLALEGEQVLEEVPADRRPAVIEE | 82 |

TABLE 17 -continued

| Entry | Sequence | SEQ ID NO: |
|---|---|---|
| | VATLLRVYRTLLGSAIPSLEEREVDLAELPLVYPLGATAWEGVIDRLYRVGDVWYLEDYKTDREV<br>HPERYHSQLALYREAVRKHWGIEPEVRLWLRTGQVVPLDAAALKEGLASYTGG | |
| E4UAI8 | MNEHERVIAHEVGPAAVVAGAGSGKTRAATLRAARLARTGERVGLVTFTASAAEEMRQRVL<br>AEDVPAKHVWAGITHSLAFQILRQFPEAGGYEGFPEVLTPNDELRLFRRLWAELLDQDLDAEL<br>RRKLVKALGFFRKARAEEALEGWAARAGESLELDAEMLEALMISFQLRKREAGLASFDDLIEG<br>ASRALGDKDVRKWADRRFPFLIVDEYQDTSRAQETFLAALMPGEAPNLMVIGDPNQAIYGW<br>RGAGSRTFERFQARYPQAVLYPLRKNYRSTRAVLRLAERAIARLYRSGQEAYYRLEGVKEEGEP<br>PVLLTPPNAAAEATDVAREVARAVASGVPPEEIAVLARSSMQLAGVEDRLARLGVATRLLGGI<br>RLSERREVICTLVQLIXAAWSLHERALVDFIEEAVPGLGERTLTRVEHAARPYNLVDRIMNDGA<br>FVRGFSTRVQQGLFMTRTLLQLARATFEGVTGEAFAERFREFAQDLYGELLPGYLARIGKQGP<br>NEEARRRHLEREVATVEAFAREEAEGGLDDLLARLAFLEQQDGPAVTLGTVHAVKGLEFEVVF<br>WGMVEGAFPLADDSDPEEERRLFYVAATRAKRRLYLSAPTYGPRGKILQPSRYLEEALDEGLV<br>RLQKVRPAA | 83 |
| E4UAI4 | MVSEGRWKIERVVYLKDGFAVVAVRNEAGERHTAVGEMPTPVEGTWVRMETEHTVHPRY<br>GPRLRVVRFLGLAPPPSKELAKIEGYLKLGFSEEAASWIAAREGSRPERAFDKPQELLVPGVPRE<br>VLRRVFPRLERLLGGLIDLLGEGHTAAPLFLLAERSGLGKEEIQELAREARKQRLIVEEQGRYGLV<br>QPYRTERSIADGLLFRLKPGRGLRLTPPAGHGLSDEQARIFKLVRENRVVVLTGGPGSGKTTTIA<br>TLLAAPELHRMREGIAAPTGKAARRIAEVARLPAETIHRLLGLGEARRPLYHARNPLPYDLLVID<br>ETSMLDAEIAAFLVDALAPSTSVIFVGDPDQLPPVGPGQFLRDLMTRVATLRLTQIFRQAQDS<br>PIVNGAYALREGRMPLADGERLRLLPFEEEAAQTTLRTLLDELREQIVGERPQVLVPGNRGP<br>LGVRRLSPFLQQQLNPGGKPLGPIGWGMEAREGDPAVWIHNDYELGIMNGEVGVLRGGGS<br>LGLTFETPTDRFAIPGNKRSRLVLAYAMTVHRSQGSEWPAVITILPKAHMALLSRELVYTALTRS<br>KQYHTLLFHPEALYRARAVQASRRYTWLDVLLRG | 84 |
| K7QW32 | MTAPGHPDALLAPLNPAQQEAVLHFQGPALVVAGAGSGKTRTVVHRVAYLMAHRGVYPGE<br>ILAVTFTNKAAEEMKGRLKALVPGAGELWVATFHSAALRILRVYGEAIGLKPGRNYDEADQE<br>ALLKEVLKELGLSAKPGPLKALLDRAKNRGEAWEALEIPDYYAGLPKGKVLDVLRRYQEALRAQ<br>GALDFGDILVYALRLLEENPEVLAKVRKRARFIHVDEYQDTSPVQYRFARLLAGEEANLMAVG<br>DPDQGIYSFRAADIRNILDFTRDFPGARVYRLEENYRSTEAILRFANAVIQKNRLRLEKTLRPVKP<br>GGEPVRVYAAPEAREEAREVAEEIFRLGPPYERFAVLYRTNAQSRLLEQALAAKGLPYRVVGGV<br>GFFERAEVKDLLAYARLSLNPEDGVSLKRVLNTPPRGIGPATLARLEALAQAEGVPLLGAIRLGA<br>ERFPKPEPLRAFLALLDELADLAFGPPEAFFRHLLSATDYLQYLKEHHPEDAEDRLENVEELLRA<br>AKEAQDLQEFLDRVALTARADQDGGRGVALMTLHNAKGLEFPVVFLVGVEEGLLPHQSSLST<br>LEGLEEEERRLFYVGVTRAQDRLYLSYAREREVYGRREPRRMSRFLEEVPEGLYLPHDPYRQGA<br>QPKPAPRAQGAFRGGEKVVHPREGPGTVVAASGDEVIVHFEGVGLKRLSLKYADLRPA | 85 |
| K7QWX5 | MASSLSKAELVPTPEQEKALHLYRSRQDFKLVAVAGSGKTTTLRLMAESFPRRHIAYLAFNRA<br>MKEEARRKEPPNTRVFTLHALAYRRTVPGTPYEAKERLGNGQVRPVHVRERLQVDPLLAYVV<br>RSGLERFIRSGDPEPLPRHLPRDWRKTVEARGPSGFAEVERAVKGVALLWKAMRDPKDPFPL<br>SHDGYVRIWREEGAGGDPPAGVILVDEAQDLDPNFLTVLSGWRGKAQQVFVGDPRQQIYG<br>WRGAVNAMGEIDLPESPLTVVSFRFGEPLASFVQAVTARQTQGLVPLVGRAGWATEVHVNL<br>EPTPPFTILTRSNLGLVTALLEGAQLFSLQKEEAHWGGVEELVWLLTDLQAIKEGGERPRPHPE<br>LLGISKWEEVESLAEYSIVLNRLLRLAKEYDLEALAHKIAQLEIGPEEGAKLVLSTAHKAKGREWD<br>RVLLWEDFYWVAAYRWFFPNTAPPPSEPSPEFLEEENIFYVAMTRARLGLHISLPEALAEEEAK<br>RILDRLSQGVPSGEDRGEDERGETLPAPFTGPTPVSPKEATFPLPSLYDRLLSEALNGGRDPLLH<br>LLRDDLARLSALSPTPLPPEVAQALWERARPEEALGAIREGLGAMWREDPYELLRAINALALLG<br>GRNPRKLAKILGDRFPGGEEAEDLLFVARARKRELMGRSLAEFWRGLGASVRHPLLKAYARARS | 86 |
| K7QTS9 | MRLYVASAGTGKTETLMGELKALLEGGVPLRRVAAVSFTRKSAEELRLRVRRLLEAHREAFWA<br>REALREVHGALFTTLHGFMAEALRHTAPFLGLDPDFRVMDGFLAQALFLEEARSLLFLEGHPE<br>APELLELLEALYEKRSLAEAFTPLPGAEGLLALYERVLARYRARTQEVLGPGDLEAKALLLLRHPE<br>ALGRVAERFSHLLVDEFQDVNPLQGRFLRALEEAGVRWAVGDPKQSIYLFRNARVEVFLRAR<br>AAAEEVRALSRTHRHAKQVVELLNRFTTRFFRAEEGNRVEVGVREAEGRVEVHWVLGKLEEAR<br>RAEARLLAQRLLALRAEGIPFGEMAVLVRARTSLPPLEKALRAAGVPFVRGRGQSFFARPEVR<br>DLYHALRLALAERPYALEDRLSLLAFLRSPFLGLDLSELEEALRAEDPWPLLPKGVQEALEGLRAL<br>ALLPPLEALRRLARDEGFLRRISRRARANLDTLLLLAAGAREPTLEDLLLWLALRAKDPESVELPE<br>GGGGVTLLTVHGAKGLEWPWALYLDVSRGPSERPPPLLVDEEGRVLKLGTEAYRALLKEAERA<br>EREEALRLLYVALSRARDLLLITGSTSQRPGPWAEALQALGLGPDAQDPWVETHPLEAIPPLPPI<br>PQAPQDPRPAPYTPWRGEPRARPPWSPSAHLKAEAEPLEVLGEGEALPEWARAVGTLVHY<br>AIARHLDPEDEGAMGGLLRQEVALAFGEGEREALLEEVRALLRAYRSLLSGALPPLEARAEDHA<br>ELPLLLPHKGTVWYGVLDRLYRGDRWYLDDYKTDQKVRPEAYRFQLALYRKAVLEAWGVE<br>AEARLVYLRHRQWPLSPAELEAALEGL | 87 |
| D1AF88 | MSSSQVTGRPTIVKDAEIAVEQRRVDQAHARLEEMRAEAQAMIEEGYRQALAGTKGSLVDR<br>DAM\NQAALRVQALNVADDGLVEGRLDLADGQTRYIGRIGVRTRDHEPMVIDWRAPAAEA<br>FYRATPEDPQGWRRRVLHTRGR-R/VDLEDDLLDPSAADSLTIVGDGAFIASLARTREGTMRD<br>IVATIQREQDEVIRAPADGTVLVRGAPGTGKTAVALHRVAYLLFRHRRRFGSRGVLWGPNRR<br>FTAYIERVLPSLGEGSATLRSLGDLVEGVSATVHDPPELAALKGSAAMAPVLRRAVTDHPPGA<br>PDKLRWHGGVWELGRPQLDKLRTSLHRRSTGSVNASRRRVAEALLDALWERYVHTGGTEP<br>EPDEPVQGELALWEGILAEGGLAPLDEQDRPSSPADRTSREAFVKNVREQRAFTDFLTAWW<br>PIRRPLDVLRSLGDAARLRRAAGRDLDRAQVELLAASWRRALAGDPPTLSYQDIALLDEIDALL<br>GPPPQPSRATAREEDPYVVDGIDILTGEWADEDWEPGLQELTTTERLERARRVDDEVADVR<br>PEYAHIWDEAQDLSPMQWRMLGRRGRQATWTIVEDPAQSAWEDLEEARKAMEAALDGP | 88 |

TABLE 17 -continued

| Entry | Sequence | SEQ ID NO: |
|---|---|---|
| | AARRGRSRRPRRRPRHEYELITNYRNTTEIAAVSARVLRLALPEARPARAVRSSGHRPVIDLVP EEELQAAARRAVRTLLECIVEGTIGVIVPLPGDAWGESDRRALSAGFPERVQVLDVLEAKGLEF DAAVICAPETIAAQSPRGLRVLYVAVSRATQRLTVLTADPWVRRRLAGGESAR | |
| F8A884 | MTSISLDQYQECtAVKAKGNTLWAGPGAGKTRVLLAKAIHLLEQGIDPEKVLILTFTIKTTQELK ERLASIGIKGVKVDTFHALAYDLLKAKGIKPRLATEEELKALARDLSKRKGLSLKDFRKALDKGEN HYRSLWEEALKLHGLYDFSLLLKEATGHYLQQEKVYLLIDEFQDLNPELTSFLKTFTKAEFFLVGD PAQAIYGFRGACPQVIKEFVDYLAPQIYFLKKSYRVPEKVLNFAETLRETQGFPLEPLEAVQKGG NRLGLSFNKPFNEAKGVAKLVSELLGGLQMEASQRGLAPPEIAILSRVRTLLNPIKEAFIKFGIPF QVPSENLKEEISAIESLSDIAKSIKSLKELEAYLAEGPSSVKEAWLESQSLEGFLFRLEMLKTFASISI RKDGVPLLTIHEAKGLEFKWILVGAEDGLPFTLLEDYDLAEEKRVAYVAVTRAQESFYFTQVK TGRFLYGHKLSGKVSPFFETLPIKEKSSKTKPKARQKKLFG | 89 |
| A0A087LEB0 | MTISVIDELLEKNKQNMNKTAKDAVEAQUAYKKEVKKLQEIRPHPYFGRLDFEDEFGRETIYI GKKGLEKDGELIWDWRTDLGRLYNAYQGVQKTFQIGKENRPVTIHGKRGIVIKNGKVIKVTDI GKSEIIENDNGEKVKYMDDYLKEILTNTEEAHRLRDIIASIQAEQDEIIRLPKDTIIVQGAAGSGK STIALHRISYLLYQYHEQVKPKDILILAPNElFLSYIKDIVPEIElEGIEQRTFYDWASTYFTDVHDIPD LHEQVYHIYGSTEKEDLIKIAKYKGSLRFKKLLDDEVEYIGINTHPGDWIESGVILSKEEIHQFY HAKEHLPLNVRMKEVKEFIINWRNEQINIRKQQIEDEFEEAYRKWVVTLPEGEERKAVYEALEK AKQLRMKIFQEKMQHEISLIVKKMENIPALLMYKSVFQKKVFEKFHPDIDEELLSLLLKNGRQIK QERFMYEDIAPLIYLDAKINGKKLQYEHIVIDEAQDYSPFQLAIMKDYAKSMTILGDIAQGIFSFY GLDRWEEIESYVEKEKEFKRLHLQTSYRSTKQIMDLANRVLLNSNYDEPLVIPVNRPGDVPTIKK VESIGELYDEIVNSIRIFEEKGYKKIAILTASKQGAIDTYDQLMRRQITQMEVITEGHQALKEKIVII PSYLVKGLEFDAVIIEDVSDETEKDETQHAKMLYMSITRAHHDLHLFYRGNISPLLEERDPSAPP KPRKSFADWLITDINDPYVEPQVEAVKRVKKEDMIRLFDDEEEEFVEEAFEDDRERYYDFHAW LKVWRRWAEMRKQLDEKS | 90 |
| B5Y6N2 | MALPQENLIPPSPSHNHLTLSLRSHIGGFFIYNEDVDSVDLSKLNEAQKQAVTAPPKPLAIIAGP GSGKTRVLTYRALFAVKEWHLPPERILAITFTNKAADELKERLGRLIPEGDRIFAATMHSFAAR MLRYFAPYAGISQNFVIYDDDDSKGLIEDILKQMNMDTKRFRPNDVLNHISAAKARMFDCNT FPEFIRQRYGSWGYYFDTVHQVFMTYERLKEQSQALDFDDLIMVLAQRMEDRPELREMIAGL FDLVMVDEFQDTNFAQYQMLLYMTNPHYSGMNNVTIVGDPDQSIYGFRAAEYYNIKRFIDD YNPEVVFLDLNYRSNRTIVDSASALINDSPSALFERKLESIKGAGNKLILRRPFDDADAAITAAFE VQRLFIKMGIPYEEIAVLMRTRALTARVEREFATRNIQYHIIGGVPFFARREIKDILAYLRLSRNA MDRVSLKRILTMKKRGFGTASLEKLFNFAEENKLTLLEAMKAAVESLLFKKLSMNDYLESLLYTLI QTIQEIAEPSQAIYLVMEQENLLDHFRSISKSEEEYIERTENVKQLISIAEESADMDDFLQRSALG TRENNGGVEGVAISTVHGVKGLEFQAVILYYVTDGFFPHSLSVTTAEKEEERLLYVAMTRAKE HLIFYVPYKQPWGNGFEQMARPSPFLRSIPKELWDGKPNEIESLYAPYSPQQKWSE | 91 |
| D7BJL0 | MNDPIRHKEGPALVFAGAGAGKTRTLTQRVKWLVEEGEDPYSITLVTFTNKAAGEMKERIAR LVEAPLAEAVVNGTFHRFCLQSLQVYGREIGLEKVAVLDSAAQRKLAERIIAGLFPAKPPRGFT PMAALGAVSRAANSGWDDIQLATMYADLTEKIVNFRWAYEEAKKGLGALDYDDLLLRGVRL LKLSEGAARMVRRRAAYLMVDEFQDTNGVQLELVRAIAPGTSPNLMVIGDPDRSIYGWRG ANYRTILEFRQHYPGAAVYGLYTNYRSQAGWEVANRIIAQNATRKPEMQEAHLPQSEEPFLL VAKNRWEEAHEVAQAVEFYRGQGIALEEMAVLMRANFLSRDLEQALRLRGIPYQFTGGRSFF ERREIQLGMAVLKVLANPKDSLAVAALVEEMVEGAGPLGIQKVLEAAKAANLSPLEAFRNPA MVKGLRGKEVQAEAMRLAEVLQDQVARLAAEAPEYHALLKETLDRLGFEAWLDRLGEESEQ VYSRKANLDRLLQGMQEEWQEVNPGAPLQDLVGTLLLEAGDTPAEEGQGVHLMTVHASKG MEFRVVFVIGLNEGLFPLSKASSSFEGLEEERRLMYVAVTRAKEVLHLSYAADGVVSRFAQEAR VPVEEYDPRLGWSGRQNQQALKALLEIA | 92 |
| E8MZN5 | MDSLEHLNPQQRAAVTASAGPVLVLAGPGSGKTRVLTFRIGYLLSQLGVAPHHILAVTFTNKA AREMQSRVEKLLGHSLQGMWLGTFHAICARILRREQQYLPLDANEVIEDEDDQQALIKRALR DLNLDEKLYRPTSVHAAISNAKNNLILPEDYPTATYRDEVVARVYKRYQELLVSSNAVDFDDLLL YAWKLLNEFSTVREQYARRFEHILVDEFQDTNLAQYELVKLLASYHRNLEVVGDEDQS1YRWR GADYRNVLRFEEDEPDRQKILLEQNYRSTQRVLDAAQAVINRNRNRTPKRLKSTPEHGEGEKL VLYEAVDDYGEAAFVVDTIQQLVAGGKARPGDFAIMYRTNAQSRLLEEAFLRAGVPYRLVGA MRFYGRREVKDMIAYLRLVQNPADEASLGRVINVPPRGIGDKSQLALQMEAQRTGRSAGLIL MELGREGKDSPHWQALGRNASLLADEGSLLGEWHRLKDEISLPSLFQRILNDLAYREYIDDNT EEGQSRWENVQELLRIAYEYEEKGLTAFLENLALVSDQDTLPENVEAPTLLTLHAAKGLEFPIVFI TGLDDGLIPHNRSLDDPEAMAEERRLFYVGLTRAKKRVYLVRAAQRSTYGSFQDSIPSRFLKDI PADLIQQDGRGRRMGRSWQSESRRSWDDNYAGDVIGSRPERAKPSHAPILQPREKPGMRV KHPSWGEGLWDSRIQDEDETVDIFFDSVGFKRVIASIANLEILS | 93 |
| L0INW7 | MDINGQIIKLNRNKTQGTLKLTNGQKIKFKINSDSVKPIFLYEYYKFKGNMIEDTLIIDDIYGIAND ININDFTELEPSVAHDKINNICNRENVLHVGNLIDLINDENFITVVNDTIGEEKATIFLSNLQKIKD RQEYIDVWDIIKKTNPTEDINVPIKIVNALKYRASMNNITVSQLIKESPWIIEQLDIFDSITERKKIA ENIATHYGLSNDSNKAVISYAIAMTNNYIQQGHSYIPYYTLVSRVSNSLKLDENKVNDTLKFPN DNKSGYLIRDNKYKDEIENEYNSDKKIGYSVYLPKIEHMEKYIADIISSILKKKSTINKIELQKNLKLY RSENKLIFSKEQEEAIFSISDNKITVITGGAGTGKITVIKAIIDLVNKMGYTPWLAPTGIASQRVA PNVGSTIHKYARIFDTYDPVFDEIEENKENNSGKVIIVDEMSMITVPVFAKLLSVTLDADSFIFVG DPNQLPPIGAGGVFEALIELGNKNINNINTWLNQSFRSKNSIVKNAQN1LEDKPIYEDDNLNIIE AKSWNKIADEWNLIRKLLDNGVQYSDIMVLSSKRGEGKNGVSLLNERIRKEIENNKGKYAVG DIVITTRNDYDNKSSYFRSKELKKYINSIRHEERPTIENGTVGVIKDISDNEVIIEYNTPMPVEAKY NMEELDVVYIEYGFAITVHKAQGGQAKYIIFASDEPRNISREMLYTAITRCKNGKVFLIGGENED WKIKKEHSFVLSKLKYRILDNIHQQEKESKINSKIVLINQ | 94 |

TABLE 17 -continued

| Entry | Sequence | SEQ ID NO: |
|---|---|---|
| D3PR99 | MSDLLSSLNPSQQEAVLHFEGPALWAGAGSGKTRIVVHRIAYLLRERRVYPAEILAVITTNKA AGEMKERLEKMVGRPARDLWVSTFHAAAVRILRTYGEYVGLRPGFVIYDEDDQNTLLKEVLK ELELEAKPGPFRAMIDRIKNRGAGLAEYMREAPDFIGGVPKDAAAEVYRKYQSGLRMQGALD ENDLLLLTIELFEQHPEVLHKVQQRARFIHVDEYQDTNPVQYKLTRLLAGERPNLMWGDPDQ SIYGERSADINNILDFTKDYPGARVIRLEENYRSSSSILRVANAVIEKNALRLEKVLRPTRPGGEPV RLYRAPNAREEAAFVAREIVKLGNFQQIAVLYRTNAQSRLLEEHLRRANVPVRLVGAVGFFER REIKDLLAYGRVAVNPADSINLRRIVNTPPRGIGATTVSRLVEHAQKTGTTVFEAFRVAEQVISR PQQVQAFVRLLDEL1EAAFESGPTAFFQRVLEQTGFREALKQEPDGEDRLQNVEELLRAAQD WEEEEGGSLSDFLDSVALTAKEEPQGDAPAEAVTLMTLHNAKGLEFFIVELVGLEENLLPHR NSLHRLEDLEEERRLFYVGITRAQERLYLSYAEERFYGKREYTRPSRFLEDIPQDLLKEVGAFGD SEVRVLPQARPEPKPRTQLAEFKGGEKVRHPKEGSGTVVAAMGGEVIVMFPGVGLKRLAVK FAGLERLE | 95 |
| D3PLL2 | MKVRVASAGTGKTASLVLRYLELIAKGTPLRRIAGVTFTTRKAADELRVRVAAAIEEVLQTGRHLS EVASGGSRAAFQEAAREIAGATLSTIHGEMAQCLRLAAPLHLDPDFSMLGDWEAQAIFEEE WQTLRYLAQDAHHPLFGLVSDELTEPLLHLFSRRSQAEVFEPAAGEANQHLLQVYQTVYAAY EARLGANLLSPSELERKALELARNDRAMKRVLERVRVLLVDEYQDVNPVQGAFFAALEQARLP IEIVGDPKQSIYAFRNADVSVERKALREGKSEPPLTHSYRHSRVLVRELNGLIGYLAKEGLGEGLE EAPPVEGVRPEQGRLEVHWVVGELPLEELRKQEARVLAGRLAALRGPIEYSQMAVLVRSYGS VRFLEEALAEAQIPYVLLQGRGYYERQEVRDLYHALRAALDPRGLSLAVFLRSPFGQHTEAGPL KPLELPQIEGVLRADDPLGRLAQHWPSVYERLRQIQAQVRLMAPLEVLKFLIRAPLMDGRPYH DFLEPRARENVDALLFYFAPRPPQNLEGLERLELLSRQADAGDVPQSGEGVQILTVHQAKGL EWPLVAVFDLGRMNVHRPQPLYLGQGPNGGDGGRLRRVVVALPETPQFEAFRQQVKLQEE EESYRLYVAASRARDTLLTASASHGQPEGWGKVLEAMNLGPASKPYHRPDFHLQTWPYQ PAPPVRVLSQPAPLQPSPWVDARFEPEPFPPLESPSALKRLEAEPLPLPDPEEGEAVPGRARAI GTLVHYAIGQNWRPDNPQHLANLEAQEVMFPFGPDERRGIMAEVQALLEHYQELLGRALP WPRDEDYPEFAVALPLGSTVWQGVIDRLYRVGQQWYLEDYKTDQEMRPERYLVQLGIYLAA IRQAWQIEPEVRLVYLRFGWVERLDKAILEAALGEIMPKGEGLRR | 96 |
| Q9RTI9 | MTSSAGPDLLQALNPTQAQAADHFIGPALVIAGAGSGKTRTLIYRIAHLIGHYGVHPGE1LAVT FINKAAAEMRERAGHLVPGAGDLWMSTFHSAGVRILRTYGEHIGLRRGFVIYDDDDQLDI1K EVMGSIPGIGAETQPRVIRGIIDRAKSNLWTPDDLDRSREPFISGLPRDAAAEAYRRYEVRKKG QNAIDEGDLITETVRLFKEVPGVLDKVQNKAKFIHVDEYQDTNRAQYELTRLASRDRNLLWG DPDQSIYKFRGADIQNILDFQKDYPDAKVYMLEHNYRSSARVLEAANKLIENNTERLDKTLKPV KEAGQPVTFHRATDHRAEGDYVADWLTRLHGEGRAWSEMAILYRTNAQSRVIEESLRRVQI PARIVGGVGFYDRREIRDILAYARLALNPADDVALRRIIGRPRRGIGDTALQKLMEWARTHHTS VLTACANAAEQNILDRGAHKATEFAGLMEAMSEAADNYEPAAFLRFVMETSGYLDLLRQEG QEGQVRLENLEELVSAAEEWSQDEANVGGSIADFLDDAALLSSVDDMRTKAENKGAPEDAV TLMTLHNAKGLEFPWFIVGVEQGLLPSKGAIAEGPSGIEEEERRLFYVGITRAMERLLMTAAQN RMQFGKTNAAEDSAFLEDIEGLFDTVDPYGQPIEYRAKTWKQYRPTVPAATTAVKNTSPLTAE LAYRGGEQVKHPKFGEGQVLAVAGVGERQEVTVHFASAGTKKLMVKFANLTKL | 97 |
| M1E5C5 | MDLNLNEDQKRAVYSDSRALLIVAGAGTGKTRVLITRAARLIKENPDARYLLLTFTKKAAREM TTRVRELIEEDTKNRLYSGTEHSFCSNIIRRRSERVGLTNDEVIIDESDSLDLMKKVESRIYSKEKID SLIFKPKDILSLYSYARNNQDFIEIVQRKYKYVNFEDIKKIISLYELNKKERNYLDFDDDLMYGLLA IKTLEKSPFDEVLVDEFQDTNQIQAEMLYYFYDLGSRISAVGDDAQSIYSFRGAYYENMENFIKR LDAEKIILSSNYRSTQQILDIANSIIQSSYSSIKKELVANVRLKENVKPKLVIVSDDWEEARYVARE MQKFGEKGLKVAALYRAAYIGRNLESQLNSMGIKYSFYGGQKLTESAHAKDFIVISFLRVEVNP KDEIALIRILKMFPGIGEKKAEKIKDAVISGDNLKKALSKEKNLEELNIFFDKLFKITDWHDLLELVF DFYKDIMNRLYPENYEEREEDLIKFMDSSNYDNLVEYLEAFTLDPVEKSEEDNNNVILSTIHS AKGLEFDWELLSVIESVYPHFRAQSTDEIEEERRLFWAITRAKQRLIFTFPRHSKKSRGYFAKNTI SPFLREKDNYLEVFIAR | 98 |
| Q5SIE7 | MSDALLAPLNEAQRQAVLHFEGPALWAGAGSGKTRTVVHRVAYLVARRGVEPSEILAVTFT NKAAEEMRERLRGLVPGAGEVWVSTFHAAALRILRVYGERVGLRPGFVVYDEDDQTALLKEV LKELALSARPGPIKALLDRAKNRGVGLKALLGELPEYYAGLSRGRLGDVLVRYQEALKAQGALD FGDILLYALRLLEEDEEVRLVRKRARFIHVDEYQDTSPVQYRFTRLIAGEEANLMAVGDPDQG 1YSFRAADIKNILDFTRDYPEARVYRLEENYRSTEAILRFANAVIVEKNALRLEKALRPVKRGGEPV RLYRAEDAREEAREVAEEIARLGPPWDRYAVLYRTNAQSRLLEQALAGREGIPARWGGVGFFE RAEVKDLLAYARLALNPDAVSLKRVLNTPPRGIGPATWARVQLLAQEKGLPPWEALKEAART FSRPEPLRHEVALVEELQDLVEGPAEAFFRHLLEATDYPAYLREAYPEDAEDRLENVEELLRAAK EAEDLQDFLDRVALTAKEEPAEAEGRVALMTLHNAKGLEFPWELVGVEEGLLPHRNSVSTL EGLEEEERRLFYVGITRAQERLYLSHAEEREVYGRREPARPSRFLEEVEEGLYEVDPYRRPPSPPP HRPRPGAFRGGERWHPREGPERIVAAQGDEVIVHFEGPGLKRLSLKYAELKPA | 99 |
| B5YD55 | MNNQFDSEKKIFIIPSRKKKEFLERIEKDLNEEQRKWLEADGPSLVIAGPGSGKTRTIVYRVGYL VALGYSPKNIMLLTFINQAARHMINRMALIRESIEEIWGGTEHHVGNRILRVYGKIIGINEQY NILDREDSLDLIDECLEELFPEENLGKGILGELFSYKVNTGKNWDKVLKIKAPQIIDKIEIVQKVFER YEKRKRELNVLDYDDDLLFFWYRLLLESEKTRKILNDRFLYILVDEYQDTNWLQGEIIRLTREENKN ILWGDDAQSIYSFRGATIENILSEPEIFPGTRIFYLVENYRSTPEIINLANEIIKRNTRQYFKEIKPVL KSGSKPKLVVVRDDEEEAQFWEVIKELHKEGVYKDIGVLERSNYHSMAVQMELTLQGIPYE VRGGLRFFECtAHIKDMISLLKILFNPQDEISAQRFFKLFPGIGRAYAKKLSQVLKESKDFDKIFQ MQFSGRTLEGLRILKNIWDKIKVIPVQNFSEILRVFFNEYYKDYLERNYPDFKDREKDVDQLILLS ERYDDLEKELSELTLYTYAGEKLLEEEEEKDEWLSTIHQAKGLEWHAVFILRLVQGDFPSYKS MDNIEEERRLFYVAVTRAKRELYVITYLTRKVKDMNVFTKPSIFLEELPYKELFEEWIVQBEI MLSPEGGEEETKAIPLEEEILLAWRVESAALPPNFLAPVSASLHTLVREAEGKEGAELEAYAWER | 100 |

TABLE 17 -continued

| Entry | Sequence | SEQ ID NO: |
|---|---|---|
| F6DJA4 | LEELARTSWKDAIQSFLEVAAEKPEVLRAGLLWERTWNRLSPEEREALYRKAERFKPTAELASK<br>ASFLQGPPPPPKPLSPSVQAARSSPPRFTPTPEQEEAVRAFLSREDMKLVAVAGSGKIIILRL<br>MAQSAPKERLLYVAFNRSVRDEAERTFPGNVEVLTLHGLAHRHWRGSGAYQRKLAARNGR<br>VTPGDVLEALELPRERYALAYVIRSTLEAFLRSASEVPTPAHIPPEYREVLQRRDKDPFSERYVLK<br>AVRLIWKLMQDPDDSFPLSEDGFVKIWAQAGAKIRGYDAVLVDEAQDLSPVFLQVLEAHRGE<br>LRRVYVGDPRQQIYGWRGAVNAMDKLDAPERKLTWSFREGEDIARGVRRFLAHVGSPIELH<br>GKAPWDTEVSLARPEPPYTALCRTNAGAVEAVISELLEEGREGARVFWGGVDEIAWLLRDA<br>HLLKVGGEREKPHPELALVENWEELEELAKEVNHPQARMLVRLARRYDLLELARLLKHAQADE<br>EGKADLWSTLHKAKGREWDRWLWGDFIPVWDEKVREFYRKQGALDELKEEENVVYVALT<br>RARRFLGLDQLPDLHERFFQGEGLVKPPSVSPLSVGGAGVSADLLRELEVRVLAKLEDRLKEVA<br>EVLAALLVEEASKAVAEAMREMGLLGEEG | 101 |
| F6DIL2 | MSDALLAPLNEAQRQAVLHFEGPALWAGAGSGKTRTWHRVAYLVARRGVFPSEILAVTFT<br>NKAAEEMRERLRGLVPGAGEVWVSTFHAAALRILRVYGERVGLRPGFWYDEDDQTALLKEV<br>LKELALSARPGPIKALLDRAKNRGVGLKALLGELPEYYAGLSRGRLGDVLVRYQEALKAQGALD<br>FGDILLYALRLLEEDEEVLRLVRKRARFIHVDEYQDTSPVQYRFTRLLAGEEANLMAVGDPDQG<br>IYSFRAADIKNILDFTRDYPEARVYRLEENYRSTEAILRFANAVIVKNALRLEKALRPVKRGGEPV<br>RLYRAEDAREEARFVAEEIARLGPPWDRYAVLYRTNAQSRLYEQALAGRGIPARWGGVGFFE<br>RAEVKDLLAYARLALNPLDAVSLKRVLNTPPRGIGPATWARVQLLAQEKGLPPWEALKEAART<br>FPRAEPLRHFVALVEELQDLVEGPAEAFFRHLLEATDYPTYLREAYPEDAEDRLENVEELLRAAK<br>EAEDLQDFLDRVALTAKAEEPAEAEGKVALMTLHNAKGLEFPWFLVGVEEGLLPHRNSLSTLE<br>GLEEERRLFYVGITRAQERLYLSHAEEREVYGRREPARPSRFLEEVEEGLYEVDPYRRPPSPPPH<br>RPRPGAFRGGERWHPRFGPGTVVAAQGDEVTVHFEGVGLKRLSLKYAELKPA | 102 |
| F6DJ67 | MEANLYVAGAGTGKTYTLAERYLGFLEEGLSPLQWAVTFTERAALELRHRVRQMVGERSLG<br>HKERVLAELEAAPIGTLHARVCREFPEEAGVPADFQVMEDLEAALLLEAWLEEALLEALQ<br>DPRYAPLVEAVGYEGLLDTLREVAKDPLAARELLEKGLGEVAKALRLEAWRALRRRMEELFHG<br>ERPEERYPGFPKGWRTEEPEWPDLLAWAGEVKFNKKPWLEYKGDPALERLLKLLGGVKEGF<br>SPGPADERLEEVWPLLRELAEGVLARLEERRFRARRLGYADLEVHALRALEREEVRAYYRGRER<br>RLLVDEFQDTNPVQVRLLQALFPDLRAWTVVGDPNQS1YSFRRADPKVMERFQAEAAKEGL<br>RVRRLEKSHRYHQGLADFFINRFFPPPLLPGYGAVSAERKPEGEGPWVFEIFQGDLEAQARFIAQ<br>EVGRLLSEGFQVYDLGKEAYRPMSLRDVAVLGRIWRDLARVAEALRRLEVPAVEAGGGNLLE<br>TRAFKDAYLALRFLGDPKDEEALVGLLRSPFFALTDGEVRRLAEARGEGETLWEVLEREGDLSA<br>EAERARETLRGLLRRKALEAPSRLLQRLDGATGYTGVAARLPQGRRRVKDWEGTLDLVRKLEV<br>GSEDPFLVARHLRLLLRSGLSVERPPLEAGEAVFLLTVHGAKGLEWPWFVLNVGGWNRLGS<br>WKNNKTKPLFRPGLALVPPVLDEEGNPSALFHLAKRRVEEEKQEENRLLYVAATRASERLYLL<br>LSPDLSPDKGDLDPQTLIGAGSLEKGLEATEPERPWSGEEGEVEVLEERIQGLPLEALPVSLLPIA<br>ARDPEAARRRLLGEPEPEGGEAWEPDGPQETEEEVPGGAGVGRMTHALLERFEAPEDLERE<br>GRAFLEESFPGAEGEEVEEALRLARTFLTAEVFAPYRGNAVAKEVPVALELLGVRLEGRADRVG<br>EDWVLDYKTDRGVDAKAYLLQVGVYAIALGKPRALVADLREGKLYEGASQQVEEKAEEVLRR<br>LMGGDRPEA | 103 |
| G8N9P8 | MDAFPSGKPLDEAWLSSLNEAQRCtAVLHFEGPALWAGAGSGKTRIVVHRVAYLMARRGV<br>YPSEILAVITTNKAAEEMRERLKAMVKGAGELWVSTFHAAALRILRFYGERVGLKPGFVVYDE<br>DDQTALLKEVLKELGVSAKPGPIKALLDRAKNRGEPPERLLADLPEYYAGLSRGRLLDVLHRYQ<br>QALWAQGALDFGDILLLALKLLEEDPEVRKRVRKRARFIHVDEYQDTSPVQYRLTKLLAGEEAN<br>LMAVGDPDQGIYSFRAADIKNILQFTEDFPPGAKVYRLEENYRSTERILRFANAVIVKNALRLEKT<br>LRPVKSGGEPVRLFRARDAREEARFVAEEVLRLGPPYDRVAVLYRTNAQSRLLEQALASRGIGA<br>RWGGVGFFERAEVKDLLAYARLALNPLDAVSLKRVLNTPPRGIGPATVEKVQA1AQEKGLPLY<br>EALKVAAQVLRPRPEPLRHFLALMEELMDLAFGPAEAFFRHLLEATDYPAYLKEAYPEDLEDRLE<br>NVEELLRAAREAEGLMDFLDKVALTARAEEPGEAGGKVALMTLHNAKGLEFPWFLVGVEEG<br>LLPHRSSVSTLEGLEEERRLFYVGTRAQERLYLSYAEEREVYGRPEASRPSRFLEEVEEGLYEEY<br>DPYRLPPPKPVPPPHRAKPGAFRGGEKWHPREGLERNAASGDEVIVHFDGVGLKRLSLKY<br>ADLRPA | 104 |
| Q1J014 | MPDLPASSLIAQLNPNQAQAANHYTGPALVIAGAGSGKTRTLVYRIAHLIGHYGVDPGEILAV<br>TFTNKAAAEMRERARHLVEGADRLWMSTFHSAGVRILRAYGEHIGLKRGFVIYDDDDQLDIL<br>KEIMGSIPGIGAETHPRVLRGILDRAKSNLLTPADLARHPEPFISGLPREVAAEAYRRYEARKKG<br>QNAIDEGDLITETVRLFQEVPAVLERVQDRARFIHVDEYQDTNKAQYELTRLLASRDRNLLWG<br>DPDQSIYRFRGADIQNILDFQKDYLDAKVYMLEQNYRSSARVLTIANKLIENNAERLEKTLPVK<br>EDGHPVLFHRATDQRAEGDFVAEWLTRLHAEGMRFSDMAVLYRTNAQSRVIEESLRRVQIP<br>AKIVGGVGFYDRREIKDVLAYARLAINPDDDVALRRIIGRPKRGIGDTALERLMEWARVNGTSI<br>LTACAHAQELNILERGAQKAVEFAGLMHAMSEAADNDEPGPFLRYVIETSGYLDLLRQEGQE<br>GQVRLENLEELVSPAEEWSRENEGTIGDFLDDAALLSSVDDMRTKQENLKDVPEDAVTLMTL<br>HNAKGLEFPWFIVGTEEGLLPSKNALLEPGGIEEERRLFYVGITRAMERLFLTAAQNRMQYGK<br>TLATEDSRFLEEIKGGFDIVDAYGQVIDDRPKSWKEYRPTESARPGAVKNTSPLTEGMAYRGG<br>EKVRHPKFGEGQVLAVAGLGDRQEVTVHFPSAGTKKLLVKFANLTRA | 105 |
| Q745W4 | MALRPTEEQLKAVEAYRSGQDLKWAVAGSGKITTLRLMAEATPGKRGLYLAFNRSVQQEA<br>ARKFPRNVRPYTLHALAFRMAVARDEGYRAKFQAGKGHLPAQAVAEALGLRNPLLLHAVLGT<br>LEAFLRSEAASPDGMIPLAYRTLRAGTKTWPEEEAFVLRGVEALWRRMTDPKDPFPLPHGA<br>YVKLWALSEPDLSFAEALLVDEAQDLDPIFLKVEAHRGVVGDPRQQIYGWRGAINA<br>MDRLEAPEARLTWSFRFAETLARFVRNLTALQDRPVERGKAPWATRVDAALPRPPFTVLCR<br>TNAGWGAWVTHEVHRGRVHWGGVEELVHLLRDAALLKKGEKRTDPHPDIAMVETWEE<br>LEALAEAGYAPAYGVLRLAQEHPDLEALAAYLERAWTPVEVAAGWVSTAHKAKGREWDRV<br>VLWDDFYPWWEEGWRVNWGSDPAHLEEENLLYVAATRARKHLSLAQIRDLLEAVDRMG<br>VYRVAEEATRAYLLLSAEVLRGVATDPRVPAEHRVRALKALGYLERGEEALDSPGKPGGQG | 106 |

TABLE 17 -continued

| Entry | Sequence | SEQ ID NO: |
|---|---|---|
| Q721S0 | MSDALLAPLNEAQRQAVLHFEGPALWAGAGSGKTRTVVHRVAYLVARRGVEPSEILAVTFT NKAAEEMRERLRGLVPGAGEVVVVSTFHAAALRILRVYGERVGLRPGFVVYDEDDQTALLKEV LKELALSARPGPIKALLDRAKNRGVGLKALLGELPEYYAGLSRGRLGDVLVRYQEALKAQGALD FGDILLYALRLLEEDEEVLRLVRKRARFIHVDEYQDTSPVQYRFTRLLAGEEANLMAVGDPDQG IYSFRAADIKNILDFTRDYPEARVYRLEENYRSTEAILRFANAVIVKNALRLEKALRPVKRGGEPV RLYRAEDAREEAREVAEEIARLGPPWDRYAVLYRTNAQSRLLEQALAGRGIPARWGGVGFFE RAEVKDLLAYARIALNPLDAVSLKRVLNTPPRGIGPATWARVQLIAQEKGLPPWEALKEAART FPRPEPLRHEVALVEELQDLVEGPAEAFFRHLLEATDYPAYLREAYPEDAEDRLENVEELLRAAK EAEDLQDFLDRVALTAKAEEPAEAEGRVALMTLHNAKGLEFPWFLVGVEEGLLPHRNSVSTL EGLEEERRLFYVGITRAQERLYLSHAEEREVYGRREPARPSRFLEEVEEGLYEVYDPYRRPPSPPP HRPRPGAFRGGERVVHPREGPGTVVAAQGDEVEVHFEGFGLKRLSLKYAELKPA | 107 |
| F2NK78 | MDLLRDLNPAQREAVQHYTGPALVVAGAGSGKTRIVVHRIAYLIRHRGVYPTEILAVTFTNKA AGEMKERLARMVGPAARELWVSTFHSAALRILRVYGEYIGLKPGFVVYDEDDQLALLKEVLG GLGLETRPQYARGVIDRIKNRMWSVDAFLREAEDWVGGLPKEQMAAVYQAYEARMRALG AVDFNDLLLKVIGLFEAHPEVLHRVQQRARFIHVDEYQDTNPAQYRLTRLLAGAERNLMVVG DPDQSIYGFRNADIHNILNFEKDYPDARVYRLEENYRSTEAILRVANAVIEKNALRLEKTLRPVRS GGDPVFLYRAPDHREEAAFVAREVQRLKGRGRRLDEIAVLYRTNAQSRVLEEAFRRQNLGVRI VGGVGFYERREVKDVLAYARAAVNPADDLAVKRVLNVPARGIGQTSLAKLSQLAETARVSFFE ALRRAGEVLARPQAQAVQREVALIEGLANAAYDTGPDAFLRLVLAETGYADMLRREPDGEAR LENLEELLRAAREWEEQHAGTIADFLDEVALTARAEEPEGEVPAEAVTLMTLHNAKGLEFPVV FIVGVEEGLLPHRSSTARVEDLEEERRLFYVGITRAQERLYLTLSEERETYGRREAVRASRFLEDIP EAFLQPLSPFGEPLGAGREPVAVRPTRRSSAAGGFRGGEKVRHPRFGQGLVVAASGEGDRQE VTVHFAGVGLKKLLVKYAGLERIE | 108 |

TABLE 18

```
>tr|L0B9N8|L0B9N8_9EURY UvrD Rep helicase SFIOS = Thermococcus
sp. EXT9 GN = e9a-1 PE = 4 SV = 1 (SEQ ID NO: 58)
MSEALPVISFEFSLPEESVIKIYGPPGTGKTTILVRIIEHLIGETHDHTEFLESYGLSLLF
GQYGAEDVIFMTFQTSALKEFEARTGIKVKDRQNKPGRYYSTVHGIAFRLLIDSGAIDGV
ITQNFGSLSPEDINFRLFQRQNGLRFESSEMGYSNVENDGNRLWNALTWAYNVYYPTKGPK
ARHEALKRLAFKLWKYPPLWEEYKTEKGILDYNDMINKAYEGLKSGEIDPRNLPGHKYSP
KVLIVDEFQDLSPLUEIERLLANYMDLVIIAGDDDQTIFSYQGADPRLMNYVPGREIVL
KRSYRLPIVVQAKAMTVISKTRHRKEKTVAPRIDLGDFKYLFWEPDFLNDLVREAUGH
SIFILVRTNRQVLKLGKELILAGVHFRHLKVDYRSIWEAGSKEWGTERDLVQALLKARRG
EELEIADLVTILYYSELIDWHLGEKLPEKERYKKIAEQMEKTIEAIEKGLMPFDILKVKD
DPFSVLDLEKIESLSPRHGKVAVELIREIMKEKSQVEVPRDAEITLDTLHASKGREADV
VFLINDLPRKWSSILKTREELDAERRVWYVGLTRARKKVYLLNGKEPFPVL >tr|L0B9J0|L0B9J0_9EURY UvrD Rep helicase SFIOS = Thermococcus
sp. IR148 GN = 148-1 PE = 4 SV = 1 (SEQ ID NO: 59)
MRVKIYGPPGIGKITTLQRTIDYTLGNSSEPPIPLPESEPTDLEPKNLAFVSFINTAIDV
IGKRTGITTRSKEAPYMRTIHGLILSVLAEHFDPVAVDNLGKLADIQAEFSMRMGYYYSK
DPFEFAEGNMKENVITRALELYLPKTGDVEEALKLIDNREDRKFALAWYRYKRQKKIMDF
DDILVIGYEHLEDFYVPVEVAFIDEGQDNGPLDYILLEKGFEGAKFVFLAGDPLQSIYGF
KGADPRLEVRWKADKETILPRBYRLPKKVWLLSQSWAISLGIKGAVVRYAPSEKLGRVSR
MKFIEALSYAVEQAKRGRSVLILARTNSLVKFVGNILSIEFGVAYGHLKRASYWESHLLK
FIEGLQMLKLWDGVTPIKVQDTKPITGLIRKLKDKHAREVLRRWRDSROISLEVQAVLQR
IKKNPSEYFYITDFDRQALKAYFSKARLDLTEELIIDTIHAAKGEEADVVIFLDFIPTRS
EERINPEELQEKLVAYVGFTRAREELIIVPIPAIKYEPMRDFMGVRQILGVVNEHKHLLI
KELVGGL >tr|L0BAD9|L0BAD9_9EURY UvrD Rep helicase SFIOS = Thermococcus
sp. IRI33 GN = i33-1 PE = 4 SV = 1 (SEQ ID NO: 60)
MSEALPVTSFEFSLPRERIIKLYGAPGTGKTTILVKIIEHLIGFUHTEFLENYGINLPF
GWEPGEVIENTFQTSALKEFEARTGIKVKDRQNKPGRYYSTVHGIAFRLLIDSGAVDGL
ITQNFGSLSPEDINFRNFCRQNGLRFESSEMGYSNVENEGNQLWNALTWAYNVYYTTKGPK
ARYEALKRLAFKLWKEPPLWEEYKKGRGILDYNDMTVRAYEGLRSGEIDPRNLPGHKYSP
KVLIVDEFQDLSPLUEIFRLLANHMDLVTIAGDDDQTIFSYQGADPRLMNYVPGREIVL
RKSHRLPIVVQAKALTVISKTRHRKEKTVAPRIDLGDFKYKLFWPDFLNDLVREAUGH
SIFILVRTNRQVLKLGKELILAGVHFEHLKVDYRSIWEAGSKEWGTERDLVQALLKAKRG
EELEVADLVTILYYSELIDWHLGEGISEKERYKKIAEQMEKTIEAIEKGLMPFDVLRVKE
NPFSVLDLEKIESLSPRHGKVAVELIKELMKEKSQVVEIPKDARIYLDTLHASKGREADV
VFLINDLPRKWSSILKTREELDAERRVWYVGLTRARKKVYLLNGKEPFPVL >tr|L0BAT5|L0BAT5_9EURY UvrD Rep helicase OS = Thermococcus sp.
AMT7 GN = a7-1 PE = 4 SV = 1 (SEQ ID NO: 61)
MSEALSITSFDFTLPRERIIKIYGPPGTGKTTILVRIIEHLIGFUHTEFLENYGLSLPF
GQYGAEDVIFMTRNSALKEFEARTGIKVKDRQNKPGRYYSTVEGIAFRLLIDSGAVDGL
ITQNFQSLSPEDWFRHFCRQNGLRFESSEMGYSNIFNEGNQLWNALTWAYNVYYTTKGPK
ARYEALKRLAFKLWKETPLWEEYKEKGILDYNDMLTRAYEGLKSGEIDPRNLPGHKYSP
KVLIVDEFQDLSPLUEIFRLLANHMDLVIIAGDDDQTIFSYQGADPRLMNYVPGREIVL
```

TABLE 18 -continued

SKSYRLPIVVQAKALTVISKTRHRKEKTVAPRIDLGDFKYKLFWFPDFLNDLVREAUGH
SIFILVRTNRQVLKLGKELILAGVHFEHLKVIDYRSIWEAGSKEWGTFRDLVQALLKAKKG
EELEVADLVTILYYSELIDWHLGERISEKERYKKIAEQMEKTIEAIEKGLMPFDILKVKE
NPFSVLDLEKIESLSPRHGKVAVELIKELMKEKSQNEIPKDAKITLDILHASKGREADV
VFLINDLPRKWSNILKTREELDAERRVWYVGLTRARKKVYLLNGKHPFPIL

>tr|W8NUG2|W8NUG2_9EURY Superfamily IDNA and RNA helicase and
helicase subunits OS = Thermococcus nautili GN = BD01 1302 PE = 4
SV = 1 (SEQ ID NO: 62)
MNENEKLSKFIAKLKVL1EMERKAEIEAMRAEMRRLSGREREKVGRAVLGLNGKV-IGEEL
GYFLVRYGREREIKTEISVGDLVVISKRDPLKSDLVGTVVEKGKRFITVALETVPEWALK
SVRIDLYANDITFKRWLENLENLRESGRRALELYLGLREPEGGEEVEFTPFDKSLNASQR
RAIAKALGSPDFFLIHGPFGTGKTR7LVELIRQEVARGNRVLATAESNVAVDNLVERIVD
SGLKVVRVGHPSRVSRGLHETTLAYLMTQHELYGELRELRVIGENLKEKRDIFTKPAPKY
RRGLTDRQILRLAEKGIGTRGVPARLIREMAQWLKINEQVQKTFDDARKLEERIAREIIR
EADVVLTTNSSAGLEVVDYGSYDVAIIDEATQATIPSVLIPINRAGRFVLAGDHKQLPPT
ILSEKAKELSKTLFEGLIERYPGKSEMLIVQYRMNERLMEFPSREFYDGRIEADESIRRI
TLADLGVKSPEDGDAWAEVLKPENVIVFIDTARREDRFERQRYGSESRENPLEARLVKEA
VEGILRLGVKAEWIGVITPYDDQRDLISSLLPEEIEVKTVDGYQGREKEVIVLSEVRSNR
KGELGELKDLRRLNVSLTRAKRKLILIGDSSILSSHPTYRRIVEFVREREETVVDAKRIIG
KVKIK >tr|B6YXQ7|B6YXQ7_THEONUvrD/REPhelicase OS = Thermococcus
onnurineus (strain NA1) GN = TON_1380 PE = 4 SV = 1 (SEQ ID NO: 63)
MIAPIPTTYSILGVAGAGKITQLIDLLNYLNFENSRNEKIWERHFEPVELNRIAFISFSN
TAIQEIANRIGIEIKARKKSAPGRYFR7VTGLAEVLLYENNLMTFEEVRSVSKLEGFRIK
WAREHGMYYKPRDNDISYSGNEFFAEYSRLVNTYYHVKSLSEIIEMHSKSHLLLDYIREK
EKLGIVDYEDILMRAYDYRNDIVVDLEYMIIDEAUNSLLDYAILLPIAKNNATELVLAG
DDAQLIYDERGANYKLEHKLIERSEIILNLTETRREGSEIANLATAIIDDMNYIQKREVL
SAATHSTKVAHIDLFQ1vEvISILQMATTDLTVYILARTNAVLNYVAKVLDEYKIQYKKNER
ITDFDRELLSLNRLMRNEYTNDDIYITYNYLRNKVAREEELKERLFQHKLHWTEKDVLGI
LLLAYEQTTAKRILTTAKNINFKIKLSTIHSAKGSEADVVFLINSVPHKTKMKILENYEG
EKRVLYVAVIRARKFLFIVDQPVARRYEQLYYIRSYESRAQGSLVNRVAVPVA.

>tr|Q5JFK3|Q5JFK3_THEKO DNA helicase, UvrD/REPfamily
OS = Thermococcus kodakarensis (strain ATCC BAA-918/JON12380/
KOD1) GN = 1K0178 PE = 4 SV = 1 (SEQ ID NO: 64)
MNEKEVILSKFIAHLKELVEMERRAEIEAMRLEMRRLSGREREKVGRAVIGLNGKVIGEE
LGYELVRYGRDREIKTEISVGDLVVISKRDPLKSDLVGIVVEKGKRFLIVAIETVPEWAI
KGVRIDLYANDITEKRWMENLDNLRESGRKALELYLGLREPEESEPVEFQPFDKSLNASQ
RGAIAKALGSGDFFLVHGPFGTGKTRILVELIRQEVARGHKVLATAESNVAVDNIVERLA
DSGLKVVRIGHPSRVSKALHETTLAYLITQHDLYAELRELRVIGENLKEKRDIFTKPAPK
YRRGLSDREILRLAEKGIGVPARLIREMAEWIRINQQVQKTEDDARKLEERIAREII
QEADVVLITNASAGLEVVDYGEYDVAWIDEATQATIPSVIIPINRAKRFVLAGDHKQLPP
TILSEKAKELSKTLFEGLIERYPEKSEMLTVQYRMNERLMEEPSREFYDGKIKARESVKN
ITLADLGVSEPEFGNEWDEALKPENVLVFIDISKREDRFERQRRGSDSRENPLEAKLVTE
TVEKLLEMGVKPDWIGVITPYDDQRDLISSMVGEDIEVKIVDGYQGREKETIVLSFVRSN
RRGELGELTDLRRLNVSLTRAKRKLIAVGDSSTLSNHPTYRRFIEFVRERGIFIEIDGKK
H >tr|C6A075|C6A075_THESMDNA helicase, UvrD/REPfamily
OS = Thermcoccus sibaricus (strain MM739/DSM12597)
GN = TSIB 2009 PE = 4SV = 1 (SEQ ID NO: 65)
MIRVQIPAGAPKYGPVAUGQSARLISGRSGVRSPAGPPKALLKERFRELFIHKNPVITM
HVKNYIAKLVDLVELEREAEIEAMREEMRRLKGYEREKVGRAILNLNGKIIGEEFGFKLV
KYGRKEAFKTEIGVGDLVVISKGNPLASDINGTVVEKGSRFIVVALETVPSWAFRNVRID
LYANDITERRQLENLKKLSESGIRALKLILGKETPLKSSPEEFTPFDRNLNQSQKEAVSY
ALGEEDFFLIHGPFGTGKTRTLVELIVQEVKRGNKILATAESNVAVDNLVERLWGKVKLV
RIGHPSRVSVHLKESTLAEWESHERYRKVRELRNKAERLAVMRDQYKKPIPQMRRGLIN
NQILKLAYRGRGSRGVPAKDIKQMAQWITLNEQIQKLYKFAEKIESEIIQEIIEDVDVVL
STNSSAALEFIKDAEFDVAIIDEASQATIPSVLIPIAKARREVLAGDHKQLPPTILSEEA
RALSETLFEKLIELYPPFKAKMLEIQYRMNQLLMEFPSREFYNGKIKADGSVKDITLADLK
VREPFFGEPWDSILKREEPLIFVDTSNRIDKWERQRKGSTSRENPLEALLVREIVERLLR
MGIKKEWIGTITPYDDQVDSIRSIIQDDEIEIHTVDGYQGREKEIIILSLVRSNKKGELG
FLMDLRRLNVSITRAKRKLVVIGDSETLVNHETYKRLIHFVKKYGRYIELGDTGIN >tr|W0I5I1|W0I5I1_9EURY DNA helicase, UvrD/REPfamily protein
OS = Thermococcus paralvinellae GN = TES1_2001 PE = 4 SV = 1
(SEQ ID NO: 66)
MNLIRYINHLKELVELEREAEIEAMREEMRKLIGYEREKVGRAVLGLNGKIIGEEFGYKL
VKYGRKQEIKTEISVGDLVVISKGNPLASDLIGTVTEKGKRPLVVALETVPSWALRNVRI
DLYANDITFKRQTENLDKLSESGKRALRFILGLEKPKESIDIEFKPFDEQLNESQKKAVG
LALGSEDFFLIHGPFGTGKTRIVAEVILQEVKRGKKVLNFAESNVAVDNLVERLWGKVKL
VRLGHPSRVSKHLKESTLAYQVEIHEKYKRVREFRNKAERLAMLRDQTKPITQWRRGLI
DRQILRLAEKGIGARGIPARVIKSMAQWITFNEKVQRLYNEAKKIEEEIVKEIIRQADVV
LSTNSSAALEFIKDIKFDVAVIDEASQATIPSVLIPIAKANKFILAGDHKQLPPTILSEE
AKELSETLFEKLIELYPSKAKMLEIWRMNERLMEFPSKEPLINGKIKAYDGVKNITLLDL
GVRVFSFGEPWDSILNLKEPLVFVDTSKHPEKWERQRKGSLSRENDLEAELVKEIVQKLL
RMGIKPESIGVITPYDDQRDLISLLLENDEIEVKIVDGYQGREKEVIILSFVIRSNKKGEL
GFLTDLRRLNVSLTRAKRKLIAIGDSETLSAHPTYKRFVEFVKEKGIFVQLNQYVSQTS TABLE 18 -continued >tr|B7AA42|B7AA42_THEAQ DNA helicase OS = Thermus aquaticus
Y51M023 GN = TaqDRAFT_3809 PE = 4 SV = 1 (SEQ ID NO: 67)
MGEAHPSEEALLSSLNEAQRQAVLHFEGPALVVAGAGSGKTRIVVERVAYLIARRGVEPS
EILAVTFINKAAEEMKARLKAMVRGAGELWVSTFHAAALRILRVYGERVGLKPGFVVYDE
DDQTALLKEVLKELGLAAKPGPIKSLLDRAKNQGVPPEHLLLELPEFYAGLSRGRLUVL
HRYQEALRAQGALDFGDILLYALKLLEEDGEVLKRVRKRARFIHVDEYQDINPVQYRFIR
LLAGEEANLMAVGDPDQGIYSFRADIRNILDFTQDYPKARVYRLEDNYRSTEAILRFAN
AVIVKNALRLEKTLRPVKKGGEPVRLFRAESARDEAREVAEEIARLGPPFDRVAVLYRTN
AQSRLLEQALASRGIPARVVGGVGFFERAEVXDLLAYARLSLNPLDAYSLKRVLMTPPRG
IGPATVEKVQAIARERGLPLFEALKVAALTLPRPEPLRAFLALMEELMDLAFGPARAFFR
HLLLATDYPAYLKEAYPEDAEDRLENVEELLRAAKEAESLMDFLDKVALTARAEEPAEAE
GRVALMTLHNAKGLEFPVVELVGVEEGLLPHRSSLSTQEGLEEEERRLFYVGVTRAGERLY
LSYAQEREIYGRLEPVRPSRFLEEVDEGLYEVYDPYRQSSRKPIPPPHRALPGAFRGGEK
VVEPREGPGTVAAAGDEVIVHFEGVGLKRLSLKYADLRPA >tr|B7A516|B7A516 THEAQ DNA helicase OS = Thermus aquaticus
Y51MC23 GN = TaqDRAFT_5093 PE = 4 SV = 1 (SEQ ID NO: 68)
MRVYLASAGTGKTHALVEELKGLIQSGVPLRRIAALTFIRKAEELRGRAKRAVLALSAE
DPRLKEAEREVEIGALFTTIEIGEMATEALRHTAPLLSLDPDFALLDTFLAEALFLEEARSLL
YRKGLDGGLARALLHLYRKRTLAETLHPLPGAEGVFALYLEALEGYRRRLPAELSPSDLE
ALALRILENPEALRRVVEREPHILLDEYQDTGPLQGRFFQGLKEAGARLVVVGDPKQSIY
LERNARVEVEREALKQAEEVRYLSTTYRHAQAVAEFLNRETALFGEEGVRVRPHRQEVGR
VEVHWVVGEGGLEEKRRAEAHLLLDRLMALREEGYAFSQMAVLVRSRSSLPPLEAAFRAR
GVPYALGRGRSFFARPEVRDLYHALRLSLLEGPPGPEERLAILAFLRGPWVGLDLSEVE
ALKAQDPIPLLPEAVRAKLRALRALAGLPPLEALKRLSRDEAFLRRLSPRARVNLDALLL
LAAMERFETLEALLEWLRLRAEDPEAAELPEGEEGWVLIVHGAKGLEWPVVALFDLSRG
ENPKEEDLINGLGGEVALRGTPAYKEVRKALRKAQAEEARRLLYVALSRARDVLIVTGSA
SGRPGPWVEALERLGLGPESQDPLVRRHPFKALPPLGDRPQTPPPPPLPAPYAHLAFPER
PLPFVYSPSAFTKAKEPVPLAEALEKEALPEFYRALGILVHYAIARHLDPEDEGAMAGLL
LQEVAFPFAEGEKRRLLEEVRDLLRRYRGMLGPSLPPLEAREEDHAELPLVLPLGGTVWY
GILDRIYRVGGRWYLEDYKTDREVRPFAYRFQLAIYRRALLEAWGVFAEARLVYLRHGLV
HPLDPEELERALKEGFPGMGPGEGGEKA >tr|B7A954|B7A954_THEAQ_DNA helicase OS = Thermus aquaticus
Y51MC23 GN = TaqDRAFT_4764 PE = 4 SV = 1 (SEQ ID NO: 69)
MKGLIGSSRLRVYGPPGTGKTTWLKNEVERLLRSGVPGEEIAVCAFSRAAFREFASRLAG
QVPEENLGTIHSLAYRAIGRPPLALTKDALSDWNRRVPDTWRTPRVDGRGADLLDVMDP
YEDEDSRPPGDKLYDRVAYLRNTLAPMAAWSEEERAFFQAWKSWMNAKGLVDFPGMLEAA
LAKPGGLGARFLLVDEAULTPLQLLLVEKWAQGARLALVGDDDQAIYGFMGADGASFLG
VPVEDELVLGQSYRVPARVQRVAEAVIRRVQNRAPKRYAPRGDEGEVRLLWVPPEDPYHA
VVDALERVNRGESVLFLATAKYLLEELKRELLRVGEPYANPYAPHRHSFNLFPQGARSAW
EKARSELFPNRIAADVKAWTKHVSSKVEAVKGEEARRYLESFPDEEKVGDDHPIWNVERP
EHRPHAVGRDVSWLLDHLLGNAPKTMRQSLMVAIKSPEAVLQGRARVWIGTIHSVKGGEA
DWVYVWPGYTRKAAREHPDQLHRLFYVAAJTRARKGLVLMDQGKAPHGYVWPRVDEFWGEV
WV >tr|H7GEQ71|H7GEQ7_9DEINDNA helicase OS = Thermus sp. RL
GN = RLTM0_2916 PE = 4 SV = 1 (SEQ ID NO: 70)
MEANLYVAGAGIGKTYTLAERYLGFLEEGLSPLQVVAVTFTERAALELRHRVRQMVGERS
LGHKERVLAELEAAPIGTLHALAARVCREFPEFAGVPADFQVMEDLEAALLLEAWLEEAL
LEALQDPRYAPLVEAVGYEGLLDTLREVAKDPLAARELLEKGLGEVAKALRLEAWRXLRR
RMEELFHGERPEERYPGFPKGWRXEEPEVVPDLLAWAGEVKFNKKPWLEYKXDPALXRLL
KLLGGVKEGFSPGPADERLEEVWPLLRELAEGVLARLEERRFRARRLGYADLEVHALRAL
EXEEVRAYYRGRERRLLVDEFQDTNPVQVRLLQALFPDLRAWTVVGDPNQSIYSFRRADP
KVMERFQXEAAKEGLRVRRLEKSHRYHQGLADFHNRFFPPLLPGYGAVSAERKPEGEGPW
VEHFQGDLEAQARFIAQEVGRILSEGFQVYDLGEKAYRPMSLRDVAVLGRTWRDLARVAE
ALRRLEVPAVEAGGGNLLETRAFKDAYLALRFLGDPXDEEALVGLLRSPFFALTDGEVRR
LAEARGEGETLWEVLEREGDLSAEAERARETLRGLLRRKALEAPSRLLQRLDGATGYTGV
AARLPQGRRRVKDWEGILDLVRKLEVGSEDPPFLVARHLRLLLRSGLSVERPPLEAGEAVT
LLTVHGAKGIEWPVVEVLNVGGWNRLGSWKNNKTKPLFRPGLALVPPVLDEXGNPSALFH
LAKRRVEEEEKQEENRLLYVAATRASERLYLLLSPDLSPDKGDLDPQTLIGAGSLEKGLE
ATEPERPWSGEEGEVEVLEERIQGLPLEALPVSLLPLAARDPEAARRRLLGEPEXEGGEA
WXPXXPQETEEEVPGGAGVGRMTHALLERFEAXEDLEREGRAFLEESFPGAEGEEVEEAL
RLARTFLTAEVFAPYRGNAVAKEVPVALELLGVRLEGRADRVGEDWVLDYKTDRGVDAXA
YLLQVGVYALALGKPRALVADLREGKLYEGASQWEEKAEEVLRRLMGGEGQGRQPYPLA
ATDPGHGAPG >tr|H7GE69|H7GH69_9DEINDNA helicase OS = Thermus sp. RL
GN = RLTM07977 PE = 4 SV = 1 (SEQ ID NO: 71)
MSDALLAPLNEAQRQAVLHFEGPALVVAGAGSGKTRIVVHRVAYLVARRGVEPSEILAVT
FINKAAEEMRERLRGLVPGAGEVWVSTFRAAALRILRVYGERVGLRPGFVVYDEDDQTAL
LKEVLKELALSARPGPIKALLDRAKNRGVGLKALLGELPEYYAGLSRGRLGDVLVRYQEA
LKAQGALDFGDILLYALRLLEEDEEVLRLVRKRARFIHVDEYQDTSPVQYRFTRLLAGEE
ANLMAYGDPDQGIYSFRAADIKNILDFPIRDYPEARVYRLEENYRSTEAILRXANAVIVKN
ALRLEKALRPVKRGGEPVRLYRAEDAREEARFVAEEIARLGPPWDRYAVLYRTNAQSRLL
EQALAGRGIPARVVGGVGEYRAEVKDLLAYARLALNPLDAVSLKRVINTPPRGIGPATW
ARVQLLAQEKGLPPWEALKEAARTFXRAEPLRHEVALVEELQDLVEGPAEAFFRHLLEAT
DYPTYLREAYPEDAEDRLENVEELLRAAKEAEDLQDFLDRVALTAKAEEPAEAEGKVALM
TLHNAKGLEFPVVELVGVEEGLLPHRNSLSTLEGLEEEERRLFYVGITRAQERLYLSHAEE REVYGRREPARPSRFLEEVEEGLYEVYDPYRXPKPXPPPHRPRPGAFRGGERVVHPREGP
GTVVAAQGDEVIVHFEGXGLKRLSLKYAELXPA >tr|A0A0B0SAG4|A0A0B0SAG4_9DEINDNA. helicase OS = *Thermus* sp.
2.9 GN = Q117 08170 PE = 4 SV = 1 (SEQ ID NO: 72)
MDEALLSSLNEAQRQAVLHFQGPALVVAGAGSGKIRTVVHRVAYLIAHRGVYPTEILAVT
FINKAAEEMRERLKGMVRGAGEVWVSTFHAAALRILRVITGERVGLKPGFVVYDEDDQTAL
LKEVLKELGLSAKPGPIKALLDRAKNRGEPPEALLAELPEYYAGLSRRRLLDVFERYQEA
LKAQGALDEGDILLYALRLLEEDQEVLARVRKRARFIHVDEYQDTNPVQYRFTKLLAGEE
ANLMAVGDPDQGIYSFRAADIKNILQFLADFPGAKVYRLEENYRSTEAILRFANAVIVKN
ALRLEKTLRPVKRGGEPVRLFRAKDAREEAREVAEEILRLGPPFDRIAVLYRTNAQSRLL
EQALAGRGVGARVVGGVGFFERAEVKDLLAYARLALNPLDSVSLKRILNIPPRGIGPATV
EKVARLAQEKGLPLFEALKRAELLPRPEPVRHEVALMEELMDLAFGPAEAFFRHLLQATD
YPAYLREAYPEDHEDRLENVEELLRAAKEAESLLDFLDKVALTARAEEPAGAEGKVELMT
LHNAKGLEFPVVELVGVEEGLLPHRNSLITTLEALEEERRLFYVGV7RAQERLYLSYAEER
EVIGRLEATRPSRFLEEVEEGLYQEYDPYRSPRPVPPSHRPKPGAFKGGEKVVEPREGPG
TVVAASGDEVIVHFEGVGLKRLSLKYADLRPA >tr|A0A084IL47|A0A084IL47_9GAMMATP-dependent DNA helicase Rep
OS = *Salinisphaera hydrothermalis* C41138 GN = rep PE = 3 SV = 1
(SEQ ID NO: 73)
MALPKLNPQQDAAMRYLDGPLLVLAGAGSGKTGVITRKIAHLIARGYDARRVVAVTFTNIK
AAREMKQRASKLISADDARGLIVSTFESLGLQMIREEHAALGYKPRESIEDSEDADKVLA
DLVGRDGDHRKATKAAISNWKSALIDPETATAQATGSDIPLARAYGEYQRRLKAYNAVDF
DDLLALPVHLLSTDHEARERWQSRFRYLLVDEYQDTNAAQYEMMRLLAGARAAFTVVGDD
DQSIYAWRGARPGNIADLSRDEPHLKVIKLEQNYRSVGNVLSAANQLIGASNQRAYEKTL
WEAMGPGDRVRVIAAPDEAGEAERIASEISSHKLRLGTAYGDYAILYRGNEQSRAFEKAL
RERDIPYRVSGGRSFFERSEIRDLVTYLKLMVNPDDDAAFLRIVNIPRREIGPATLEALG
RYAGSRHISLFDAARGIGLAGGVGERSGRRLADEVDWLRNLTUSEGMTPRELVSQLIVD
IDYRNWLRDTSANTKAARKRIENLDDFIGWLDRLDNAEDGKPVTLEDVVRRISLMDFANQ
SEKDVENQVHLLTLHAAKGLEFDHVFLAGLEEGMLPHHACLEDDKIEEERRLLYVGITRA
RKTLALTYARKRRGGEESDSVPSRFLEELPADELDWPSATGTRSKAANAEQGRDQVAAL
RAMLGASADS >tr|A0A0A2WMV1|A0A0A2WMV1_THEFIDNA helicase OS = *Thermus
filiformis* GN = THFILI00990 PE = 4 SV = 1 (SEQ ID NO: 74)
MPQVGFTDHEFKGLEALSREEQNRVREAVFAFMQDPKHPSFKLHRIEDIKTDREWSARVS
KDLRLILYHHPEMGWIFAYVGHHDDAYRWAETHQAEVHPKLGLLQIFRVVEEVRVEPRKI
KPLLPDYPDDYLLDLGVPPSYLKPLRLVETEDQLLGLIEGLPQDVQERLLDLAAGRPVTL
PPKLAPSEETNEKHPLSRQHIHFIQNLDELRQALSYPWERWMVELHPAQREAVERVFQGPA
RVTGPAGTGRTVVALHRAAALARRYPEEPLLLTTENRFLASRLRSGLQRLLGEVPPNITV
ENLHSLARRLHEQHVGPVIKLVKEEDYGPWLLEAAQGLEYGKNFLLSEFAFADAWGLTWE
AYRGFPRTGRGVPLTARERLKLFGAFQKVWGRMENEGALTENGLLHRLRQRAEEGALPRF
RAVVVDEAQDLGPAELLLVRALAQEAPDSLFFAIDPARIYKSPLSWQAIGLEVRGRSIR
LKVNYRTTREIAKRAEAVLPKEVEGEMREVLSLLQGPEPEIRGFPTQEACQAELVRWLRW
LLEQGVRPEEVAVLARVRKLAEGLAEGLRRAGIPVVLLSDQEDPGEGVRLGTVHSAKGLE
FRAVALFaANRGLFPLESLLREAPSEADREALLAQERNLLYVAMSRARERLWVGYWDEGS
PFLTP >tr|A0A0D0N7B7|A0A0D0N7B7_MEIRU DNAhelicaseOS = *Meiothermus
ruber* GN = SY28 04645 PE = 4 SV = 1 (SEQ ID NO: 75)
MSDLLSSLNPSQREAVLHFEGPALVVAGAGSGKTRYVVHRIAYLLRERRVYPAEILAVIF
TNKAAGEMKERLEKMVGRSARDLWVTTFHAAAVRILRTYGEYVGLKPGEVIYDEDDQNTL
LKEVLKELELEAKPGPFRSMIDRIKNRGAGLAEYMREAPDFIGGVPRDVAAEVYRRYQNS
LRMQGALDENDLLLLTIELFEQHPEVLHKVQQRARFIHVDEYQDTNPVORLTRLLAGER
PNLMVVGDPDQSIYGFRNADINNILDFIKDYPGARVIRLEENYRSSSSILRVANAVIEKN
ALRLEKVLRPTKPGGEPVRLYRAPNAREEAAFVAREIVKLGGYQQVAVLYRTNAQSRILE
EHLRRANVPVRLVGAVGFFERREIKDLLAYGRVAVNPDDSINLRRIVNTPPRGIGATTVA
RLVEHAQKTGITVFEAFRAAEQVISRPQQVQAFVRLLDELMEAAFESGPTAFFQRVLEQT
GFREALKQEPDGEDRLQNVEELLRLAQDWEEEEGGSLADFLDSVALTAKAEEPQGDAPVE
AVTLMTLHNAKGLEFPTVYLVGLEENLLPHRNSLHRLEDLEEEERRLFYVGITRAQERLYL
SYAEERETYGKREYTRPSRFLQDIPQDLLKEVGAFGDGETRVLSQARPEPKPRTQPAEFK
GGEKVKHPKFGSGTVVAAMGGEVIVMFPGVGLKRLAVKFAGLERLE >tr|W2U4X3|W2U4X3_9DEINDNA helicase OS = *Thermus* sp. N1VIX2.A1
GN = TNMX_07060 PE = 4 SV = 1(SEQIDNO:76)
MQGPQSSHPGDELLRSLNEAQRQAVLHFEGPALVVAGAGSGKTRIV-VHRVAYLIAKRGVE
PSEIAVTFINKAALEMRERLKRMVKGAGELWVSTEHSAALRILRVYGERVGLKPGFVVY
DEDDQTALIKEVLKELGLAARPGPLKALLDRAKNRGEAPESLLSELPDYYAGLSRGRILD
VLKRYEEALKAQGALDFGDILLYALRLLEEDPEVLKRVRRRARFIHVDEYQDINPVQYRF
TKLLAGEEANLMAVGDPDQGIYSFRAADIKNILEFTRDFPGAKVYRLEENYRSTEAILRF
ANALIVNNALRLEKTLRPVKPGGEPVRLYRARDARDEAREVAEEILRLGPPFDRVAVLYR
TNAQSRLLEQALASRGVPARVVGGVGFFERAEVXDLLAYARLSLNPLDGVSLKRVLNTPP
RGIGPATVEKVEALAREKGLPLFEALRVAAEVLPRPAPLRHFLALMEELQELAFGPAEGF
FRHLLEATDYPAYLREAYPEDHEDRLENVEELLRAAKEAEGLMEFLDKVALTARAEEPGE
PAGKVALMTLHNAKGLEFPVVFVVGVEEGLLPHRSSLSTLEGLEFERRLFYVGVTRAQER
LYLSYAEEREVYGRTEATRPSRFLEEVEGGLYEEYDPYRSAKVSPSPAPSEARASKPKP
GAYRGGEKVIHPREGQGTVVAAMGDEVTVHFEGVGLKRLSLKYADLRPVG TABLE 18 -continued >tr|H9ZQB5|H9ZQB5_THETH DNA helicase OS = Thermus thermophilus
IL-18 GN = TtJL18_0620 PE = 4 SV = 1 (SEQ ID NO: 77)
MSDALLAPLNEAQRQAVLHFEGPALVVAGAGS GKTRTVVERVAYLVARRGVEPSEILAVT
FINKAAEEMRERLRGLVPGAGEVWVSTFHAAALRILRVYGERVGLRPGFVVYDEDDQTAL
LKEVLKELALSARPGPIKALLDRAKNRGVGLEALLGELPEYYAGLSRGRLADVLRYQEA
LKAQGALDFGDILLYAIRLLKEDEEVLRLVRKRARFIHVDEYQDTSPVQYRFIRLLAGEE
ANLMAVGDPDQGIYSFRAADIKNILDFTRDYPEARVYRLEENYRSTEAILRLANAVIVKN
ALRLEKALRPVKRGGEPVRLYRAEDAREEARFVAEEIARLGPPWDRYAVIYRTNAQSRLL
EQALAGRGIPARVGGVGFFERAEVKDLLAYARLALNPLDAVSLKRVLNTPPRGIGPATW
ARVQLLAQEKGIPPWEALKEAARTSSRVEPLRHEVALVEELQDLVEGPAEAFFRHLLEAT
DYPTYLREAYPEDAEDRIENVEELLRAAKEAEDLQDFLDKVAITAKAEEPAEAEGKVAIM
TLHNAKGLEFPVVFLVGVEEGLLPHRNSLSLEGLEEERRLFYVGITRAQERLYLSHAEE
REVYGRREARESRFLEEVEELYEVYDPYRVPKPAPPPHRPRPGAFRGGERVVHPRFGP
GTVVAAQGDEVTVHFEGFGLKRLSLKYAELRPA >tr|E8PM35|E8PM35_TRESS DNA helicase OS = Thermus scotoductus
(strain. ATCC 700910/SA-01) GN = perAl PE = 4 SV = 1 (SEQ ID NO: 78)
MQGPQSSHPGDELLRSLNEAQRQAVLHFEGPALVVAGAGSGKTRTVVHRVAYLIAKRGVF
PSEILAVTFTNKAAEEMRERLKRMVKGGGELWVSTFHSAALRILRVYGERVGLKPGFVVY
DEDDQTALIKEVLKELGLAARPGPLKALLDRAKNRGEAPESLLSELPDYYAGLSRGRLLD
VLKRYEEALKAQGALDFGDILLYALRLLEEDPEVLKRVRRRARFIHVDEYQDTNPVQRF
TKLLAGEEANLMAVGDPDQGIYSFRAADIKNILEFIRDFPGAKVYRLEENYRSTEATLRF
ANALIVNNALREKTLRPVKPGGEPVRLYRARDARDEARFVAEEILRLGPPFDRVAVLYR
TNAQSRLLEQTLASRGVPARVVGGVGFFERAEVKDLLAYARLSLNPLDGVSLKRVLNTPP
RGIGPATVEKVEALARKGLPLFEALRVAAEVLPRPAPLRHFLALMEELQELAFGPAEGF
FRHLLEATDYPAYLREAYPEDYEDRLENVEELLRAAKEAEGLMEFLDKVALTARAEEPGE
PAGKVALMTLHNAKGLEFPVVFVVGVEEGLLPHRSSLSTLEGLEEERRLFYVGVTRAQER
LYLSYAEEREVYGRTEATRPSRFLEEVEGGLYEEYDPYRASAKVSPSPAPGEARASKPGA
YRGGEKVIHPREGQGTVVAAMGDEVIVHFEGVGLKRLSLKYADLRPVG >tr|E8PL08|E8PL08_TRESS DNA helicase OS = Thermus scotoductus
(strain ATCC 700910/SA-01) GN =perA2 PE = 4 SV = 1 (SEQ ID NO: 79)
MLNPEQEAVANHFTGPALVIAGPGGKTRTVVHRIARLIRKGVDPETVTAV7FTKKAAGE
MRERLVHLVGEETATKVFTATFHSLAYHVLKDIGTVRVLPAEQARKLIGEILEDLQAPKK
LTAKVAQGAFSRVKNSGGGRRELIALYTDFSPYIERAWDAYEAYKEEKRLLDFDDLLHQA
VHELSTDIDLQARWQHRARFLIVDEYQDINLVQFNLLRLLLTPEENLMAVGDPNQAIYAW
RGADFRLILEFKKHFPNATVYKLHTNYRSHNGIVTAAKKVITHNTQREDLDLKALRNGDL
PTLVQAQSREDEALAVAEVVKRHLDQGTPPEEIAILLRSLAYSRPIEATLRRYRIPYTIV
GGLSFWNRKEVQLYLHLLQAASGNPESTVEVLASLVPGMGPKKARKALETGKYPKEAEEA
LQLLQDLRAYTGERGEHLASAVQNTLHRHRKTLWPYLLELADGIEEEAAWDRWANLEEAVS
TLFAFAHHTPEGDLDTYLADILLQEEDPEDSGDGVKIMTLHASKGLEFAVVLLPFLVEGA.
FPSWRSAQNPATLEEERRLFYVGLTRAKEHAYLSYHLVGERGATSPSRFARETPANLIHY
NPTIGYQGKETDTLSKLAELF >tr|E4U8J8|E4U8J8_OCEP5 DNA helicase OS = Oceanithermus
profundus (strain DSM14977/NBRC 100410/VKMB-2274/506)
GN = Ocepr_1221 PE = 4 SV = 1 (SEQ ID NO: 80)
MSARDLLSSLNEQQQAAVQHFLGPAIVIAGAGSGKTR7VVHRVAYLLAEREVYPAEVLAV
TFINKLAGEMRERLSRMVGRAAGELWVSTFHSASLRILRRYGERIGLKPGFVVYDDDDQR
VLLKEVLGSLGLEARPTYVRAVLDRIKNRMWSVDEFLAHADDWVGGLIKQQMAEVYARYO
QRLAENNAVDFNDLLLRTIELFERHPEALEAVRQRARFIHVDEYQDINPAQYRLTKLLAG
DEANLMVVGDPDQSIYGFRNADIQNILGFERDYRGAVVYRLEANYRSTAAILRVANALIE
RNQQRLEKTLRPVKPAGEPVRLYRAPDHREEAAFVAREVARLAGERALDDFAVIYRTNAQ
SRVLEEAFRRLNLPARIVGGVGEYERREVKDVLAYARLAVNPADDVALRRVTNVPARGVG
AASVGKLAAWAQAQGVSLLEAAHRAGELLAARQAAAVAKFTDLLTTLREAAEGTGPEAFL
RLVLAETGYSEMLRREGDSEPRLENLEELLRAAEWEEEHGGSVAEFLDEIALTARAEEP
NAAPEKSVILMTLHNAKGLEFPVVFVVGVEEGLLPHRSSLGSDAEIEEERRLLYVGITRA
QERLYLTLSEERETWGQRERVRPSRFLEEIPEDFLKPVGPFGDAHEPAPAPLSSAPVNRA
AKGSASGERGGEKVRHPRYGEGTVVATSGEGARQEVIVHFAEAGLKRLLVKYAGLERIE >tr|E4U4N5|E4U4N5_OCEP5 DNA. helicase OS = Oceanithermus
profundus (strain DSM14977/NERC 100410/VKMB-2274/506)
GN = Ocepr_1575 PE = 4 SV = 1 (SEQ ID NO: 81)
MKVRIASAGTGKTYALTSRFTAALAEHPPYRLAAVTFTRSAAAELKARLRERLLAIAAGR
FUSGAEDVPPEAVVRRAGALATEVLGATVTTIHGEFAELLRQNALALGLEPDFLRIDAS
ESQQIFAEEARAYVYLNEEDDALAEVLGRLFAKRSLAAELRPQGEAAEALWAHFRAVLER
YARRLGGEALGPADIELHAWRILERAGREEALAARIRSRLARVEVDEYQDTSPLQGRVFA
ALEALGVEVEVVGDPKQSIYAFRNADVEVEREAMRRGEPLPPLVTSWRHDRALVRFLNRY
VDWVAEERPEAFARAEAPPVEARPDAGPGRVRLQLVQGEARQDALRPYEADQLARWLQER
HAEHAWRDMAVLVRSHSSVPLLVRALAAHGLPHVVVGGRGEYDLIEVRDLVHAARVALDP
RGRFSLAAFLRGPFAGLDLGRVERVLAAEDPLAELERAPEVAERVDRLVRWVQLRPLD
FFERMVRTPFLEGASYLERLEPPARANVDQLLFKLASRRYGRLEFLLRDLEDLRGSDEAG
VPEGGFDAVRIYTMHGSKGLETNPVVAVEDLNRGUDGAEPFYVRPGSGEFAAEGDPDYPR
FAAEWKERERQEAYRILYVALSRPRSRILLSLSVQLKPDGEGLRPKEWRRILGRTLIEEM
NLAAWDALEVERLDAARLPAPKAPRRAADVDERLRAPVEPLARPPVYSPSALKAER
PAPPELDDEGDVAVELEEPGVDPGLVARTVGILVHYAIGQDWGPERLQDLWNQEAVQRLT
EPERTRVKTEVAQRLETYWRLLGTELPALDERDEDYAEFPLLLPIRTARLDTVWEGVIDR
LYRVGDWVLEDYKTDRELHPERYHFQLALYRRAVAAAWGIEPEARLVYLRFGEVVPLEA
QLLEEAFERGTREAEEV

```
>tr|E4TJAI1|E4UAI1_OCEP5 DNA heiicase OS = Oceanithermus
profundus (strain DSM14977/NBRC 100410/VIMB-2274/506)
GN = Ocepr_2312 PE = 4 SV = 1 (SEQ ID NO: 82)
MKVIVASA = KTTRLTQRYLEHLEQHPPQRVAAVTFTNKAAAELRERIFEALGRGSFYD
FTPSPALAERLADYQVRVLEAPIGTIHSFFGYLLRLTAPMLGLDPHFEVTDPATARAWFL
EEVRNLAIIEGAEVDETVITALVELFKRRSISEAFEGTGDASRSLVAGFKKVYARNLTRL
GGRYLDPSEIERRALALIRHPEALERVRSRLGVVLVDEYQDTAPIQARVFEALEEAGVPI
EVVGDPKQSIYAFRDADVEGFREAERRARENGNVETLIVSYRHPPALADFLNAFTSAEAA
LGKAFTAEEAPEVKPGREGDARVELITVIPGDGKATLDALRNGEARLLARELRRLHDEEG
YDYGQMLVLERRRHQLPPLLRALRGAGLPFAVVGLRGLYEEPEVRELYHALRLATGEAPR
DSLAVELSGPFGGLTLGQVREVLAQDAPESYLTLHEPEAAERLLRLRADAEKMRPAEALT
RLIEAPTAKGPPFLDLLELEMADTVLYVLGRIEHTRTYPEAVATLESFRSGGEEEASLAR
LGGDAVRVMSAHAAKGLQAPVVVIFDADRTFNGNSDELVIEPRIGRVALNGEDAYESIAQ
ALKARKEGEDHRLIYVALSRSSERLIVSAAVKEPRKGSWLHHLTEVLNLGSKFEHRNVTL
AEIALEEPIEQEAATLPVDPELATPLPPAPPAVSSPTALKAERELEVPDPEEAWPADPEA
RLLGRIVGILVHEGIQRDWDPDDPEVLLALEGEQVLEEVPADRRPAVIEEVAILLRVYRT
LLGSAIPSLEEREVDLAELPLVYPLGATAWEGVIDRLYRVGDVWYLEDYKTDREVHPERY
HSQLALYREAVRKHWGIEPEVRLVYLRTGQVVPLDAAALKEGLASYTGG >tr|E4UAI8|E4UAI8_CEPS DNA helicase OS = Oceanithermus
profundus (strain DSM14977/NBRC 100410/VIMB-2274/506)
GN = Ocepr 2319 PE = 4 SV = 1 (SEGID NO: 83)
MNEHERVIAHEVGPAAVVAGAGSGKTRAATLRAARLARTGERVGLVTFTASAAEEMRQRV
LAEDVPAKHVWAGTFHSLAFQILRQFPEAGGYEGFPEVLTPNDELRLFRRLWAELLDQDL
DAELRRKLVKALGFFRKARAEEALEGWAARAGESLELDAEMLEALMISFQLRKREAGLAS
FDDLIEGASRALGDKDVRKWADRRFPPLIVDEYQDTSRAQETFLAALMPGEAPNLMVIGD
PNQAIYGWRGAGSRTFERFQARYPQAVLYPLRKNYRSTRAVLRIAERAIARIYRSGUAY
YRLEGVKEEGEPPVLLTPPNAAAEATDVAREVARAVASGVPPEEIAVLARSSMQLAGVED
RLARLGVATRLLGGIRLSERREVKILVQLLKAAWSLHERALVDFIEEAVPGLGERTLTRV
EHAARPYNLVDRIMNDGAFVRGFSTRVQQGLFMTRTLLQLARATFEGVTGEAFAERFREF
AQDLYGELLPGYLARIGKQGPNEEARRRHLERFVATVEAFAREEAEGGLDDLLARLAFLE
QQDGPAVTLGTVHAVKGLEFEVVFIVGMVEGAFPILADDSDPEEERRLFYVAAJTRAKRRL
YLSAPTYGPRGKILUSRYLEEALDEGLVRLQKVRPAA.

>tr|E4UAI4|E4UAI4_OCEP5 AAA ATPase OS = Oceanithermus profundus
(strain DSM14977/NBRC 100410/VIB-2274/506)
GN = Ocepr 2315 PE = 4 SV = 1 (SEQ ID NO: 84)
MVSEGRWKIERVVYLKDGFAV-VAVRNEAGERHTAVGEMPTPVEGTWVRMETEHTVHPRYG
PRLRVVRFLGLAPPPSKELAKIEGYLKLGFSEFLASWLAARFGSRPERAFDKPQELLVPG
VPREVLRRVFPRLERLLGGLIDLLGEGHTAAPLFLLAERSGLGKEEIQELAREARKQRLI
VEEQGRYGLVQPYRTERSIADGLLFRLKPGRGLRLIPPAGHGLSDEQARIFKLVRENRVV
VLIGGPGSGKITTIATLLAAPELHRMREGIAAPTGKAARRIAEVARLPAETIHRLLGLGE
ARRPLYHARNPLPYDLLVIDETSMLDAEIAAFLVDALAPSTSWIFVGDPDQLPPVGPGQF
LRDLMTRVATLRLTQIFRQAQDSPIVNGAYALREGRMPLADGERLRLLPFEEEEAAQTTLR
ILLDELQRLEQIVGERPQNLVPGNRGPLGVRRLSPFLQQQLNPGGKPLGPIGWGMEAREG
DPAVWIHNDYELGIMNGEVGVLRGGGSLGLTFETPTDRFAIPGNKRSRLVLAYAMTVHRS
QGSEWPAVITILPKAHMALLSRELVYTALTRSKQYHTLLFHPEALYRARAVQASRRYTWL
DVLLRG >tr|K7QW32|K7QW32_THEOS DNA helicase OS = Thermus oshimai JL-2
GN = Theos_1787 PE = 4 SV = 1 (SEQ ID NO: 85)
MTAPGHPDALLAPLNPAQQEAVLHFQGPALVVAGAGSGKTRIVVHRVAYLMAHRGVYPGE
ILAVTFTNKAAEEMKGRLKALVPGAGELWVATFHSAALRILRVYGEAIGLKPGFVVYDEA
DQEALLKEVLKELGLSAKPGPLKALLDRAKNRGEAWEALEIPDYYAGLPKGKVLDVLRRY
QEALRAQGALDFGDILVYALRLLEENPEVLAKVRKRARFIHVDEYQDTSPVQYRFARLLA
GEEANLMAVGDPDQGIYSFRAADIRNILDFTRDFPGARVIRLEENYRSTEAILRFANAY-1
QKNRLRLEKTLRPVKPGGEPVRVIAAPEAREEARFVAEEIFRLGPPYERFAVLYRTNAQS
RLLEQALAAKGIPYRVVGGVGFEERAEVKDLLAYARLSLNPEDGVSLKRVLNIPPRGIGP
ATLARIEALAQAEGVPLLGAIRLGAERFPKPEPLRAFLALLDFLADLAFGPPEAFFRELL
SATDYLQYLKEHHPEDAEDRLENVEELLRAAKEAULQEFLDRVALTARADQDGGRGVAL
MTLHNAKGLEFPVVFLVGVEEGLLPHQSSLSTLEGLEEERRLFYVGVTRAQDRLYLSYAR
EREVYGRREPRRMSRFLEEVPEGLYLPHDPYRQGAUKPAPRAQGAFRGGEKVVHPREGP
GTTVVAASGDEVIVHFEGVGLKRLSLKYADLRPA >tr|K7QWX5|K7QWX5 THEOS DNA helicase OS = Thermus oshimai JL-2
GN = Theos_2419 PE = 4 SV = 1 (SEGID NO: 86)
MASSLSKAELVPTPEQEKALHLYRSRUFKLVAVAGSGKITTLRLMAESFPRRHIAYLAF
NRAMKEEARRKFPPNTRVFTLHALAYRRTVPGTPYEAKFRLGNGQVRPVHVRERLQVDPL
LAYVVRSGLERFIRSGDPEPLPRHLPRDWRKIVEARGPSGFAEVERAVKGVALLWKAMRD
PHDPFPLSHDGYVRIWREEGAGGDPPAGWILVDEAQDLDPNELIVISGWRGKAQQVFVGD
PROQQIYGWRGAVNAMGEIDLPESPLIWSFREGEPLASFVQAVTARQTQGLVPLVGRAGWA
TEVHVNLEPTPPFTILTRSNLGLVTALLEGAQLFSLQKEEAHVVGGVEFLVWLLTDLQAI
KEGGERPRPHPELLGISKWEEVESLAEYSIVLNRLLRLAKEYDLEALAHKIAQLHGPEEG
AKLVLSTAHKAKGREWDRVLLWEDFYWVAAYRWFFPNTAPPPSEPSPEFLEEENIFYVAM
TRARLGLHISLPEALAEEEAKRILDLRSQGVPSGEDRGEDERGETLPAPFTGPTPVSPKE
ATFPLPSLYDRLLSEALNGGRDPLLHLLRDDLARLSALSPTTPLPPEVAQALWERARPEEA
LGAIREGLGAMWREDPYELLRAINALALLGGRNPRKLAKILGDRFPGGEEAEDLLFVARA
RKRELMGRSLAEFWRGLGASVRHPLLKAYARAIRS
```

TABLE 18 -continued

```
>tr|K7QTS9|K7QTS9_THEOS DNA helicase OS = Thermus oshimai JL-2
GN = Theos_0356 PE = 4 SV = 1 (SEQ ID NO: 87)
MRLYVASAGTGKTETLMGELKALLEGGVPLRRVAAVSFIRKSAEELRLRVRRLLEAHREA
FWAREALREVEGALFTTLHGEMAEALRHTAPFLGLDPDFRVMDGFLAQALFLEEARSLLF
LEGHPEAPELLELLEAGTGEKRSLAEAFTPLPGAEGLLALYERVLARYRARTQEVLGPGDL
EAKALLLLRHPEALGRVAERFSHLLVDEFQDVNPLQGRFLRALEEAGVRVVAVGDPKQSI
YLFRNARVEVFLRARAAEEVRALSRTHRHAKQVVELLNRETTREFRAEEGNRVEGVREA
EGRVEVHWVLGKLEEARRAEARLLAQRLLALRAEGIPFGEMAVLVRARTSLPPLEKALRA
AGVPFVRGRGQSFEARPEVRDLYHALRLALAERPYALEDRLSLLAFLRSPFLGLDLSELE
EALRAEDPWPLLPKGVQEALEGLRALALLPPLEALRRLARDEGFLRRISRRARANIDILL
LLAAGAREPTLEDLLLWLALRAKDPESVELPEGGGGVTLLTVHGAKGLEWPVVALYDVSR
GPSERPPPLLVDEEGRVALKGTEAYRALLKEAERAEREEALRLLYVALSRARDLLLITGS
TSQRPGPWAEALQALGLGPDAQDPWVETHPLEAIPPLPPIPQAPQDPRPAPYTPWRGEPR
ARPPVYSPSAHLKAEAEPLEVLGEGEALPEWARAVGTLVHYAIARHLDPEDEGAMGGLLR
QEVALAFGEGEREALLEEVRALLRAYRSLLSGALPPLEARAEDHAELPLLLPHKGIVWYG
VLDRLYRVGDRWYIDDYIKTDQKVRPEAYRFQLALYRKAVLEAWGVEAEARLVYLRHRQVV
PLSPAELEAALEGL >tr|D1AF88|D1AF88_THECD DNA helicase OS = Thermomonospora
curvata (strain ATCC 19995/DSM43183/JCM3096/NCIMB
10081) GN = Tcur_4104 PE = 4 SV = 1 (SEQ ID NO: 88)
MSSSQVTGRPTIVKDAEIAVEQRRVDQAHARLEEMRAEAQAMIEEGYRQALAGIKGSLVD
RDAMVYQAALRVQALNVADDGLVEGRLDLADGQTRYIGRIGVRIRDHEPMWIDWRAPAAE
AFYRATPEDPQGVVRRRVLHTRGRTVVDLEDDLLDPSAADSLTIVGDGAFIASLARTREG
TMRDIVATIQREQDEVIRAPADGTVLVRGAPGIGKTAVALHRVAYLLFRERRREGSRGVL
VVGPNRRETAYIERVLPSLGEGSATLRSLGDLVEGVSATVHDPPELAALKGSAAKAPVLR
RAVTDHPPGAPDKLRVVHGGVVVELGRPQLDKLRTSLHRRSTGSVNASRRRVAEALLDAL
WERYVHIGGTEPEPDEPVQGELALWEGILAEGGLAPLDEQDRPSSPADRTSREAFVKNVR
EQRAFTDELTAWWPIRRPLDVLRSLGDAARLRRAAGRDLDRAQVELLAASWRRALAGDPP
TLSYQDIALLDEIDALLGPPPQPSRATAREEDPYVVDGIDILTGEVVADEDWEPGLQELT
TTIERLERARRVDDEVADVRPEYAHIVVDEAQDLSPNQWRMLGRRGRQATWTIVEDPAQS
AWEDLEEARKAMEAALDGPAARRGRSRRPRRRPRHEYELTTNYRNTTEIAAVSARVLRLA
LPEARPARAVRSSGHRPVIDLVPEELQAAARRAVRILLEQVEGTIGVIVPLPGDAWGES
DRRALSAGFPERVQVLDVLEAKGLEFDAAVICAPETIAAQSPRGLRVLYVAVSRATQRLT
VLTADPVWRRRLAGGESAR >tr|F8A884|F8A884_THEID DNA helicase OS = Thermodesulfatator
indicus (strain. DSM15286/JON11887/0IR29812)
GN = Thein_0607 PE = 4 SV = 1 (SEQ ID NO: 89)
NTSISLDQYQEQAVKAKGNTLVVAGPGAGKIRVLLAKAIHLLEQGIDPEKVLILIFTIKT
TQELKERLASIGIKGVKVDTFHALAYDLLKAKGIKPRLATEEELKALARDLSKRKGLSLK
DERKALDKGENHYRSLWEEALKLHGLYDFSLLLKEATGHYLQQEKVYLLIDEFQDLNPEL
TSFLKTFTKAEFFLVGDPAQATYGERGACPQVIKEFVDYLAPQIYFLKKSYRVPEKVLNE
AETLRETQGFPLEPLEAVQKGGNRLGLSENKPFNEAKGVAKLVSELLGGLQMEASQRGLA
PPEIAILSRVRILLNPIKEAFIKEGIPFQVPSENLKEEISATESLSDIAKSIKSLKELEA
YLAEGPSSVKEAWLESQSLEGFLFRLEMLKTFASISIRKDGVPLLTIHEAKGLEFKVVIL
VGAEDGLLPFTLLEDYDLAEEKRVAYVAVTRAQESFYFTWKIGRFLYGHKLSGKVSPFF
ETLPIKEKSSKTKPKARQKKLFG >tr|A0A087LEB0|A0A087LEB0_GEOSE Uncharacterized protein
OS = Geobacillus stearothermophjius GN = GT94_17890 PE = 4 SV = 1
(SEQ ID NO: 90)
NTISVIDELLEKNKQNNNKTAKDAVEAQLIAYAKKEVVKKLUIRPHPYFGRLDFEDEFGR
ETIYIGKKGLEKDGELIVVDWRIDLGRLYNAYQGVQKTFQIGKENRPVTIHGKRGIVIKN
GKVIKVIDIGKSEIIENDNGEKVKYNDDYLKEILTNTEEAHRLRDITASIQAEQDETIRL
PLKDTIIVQGAAGSGKSTIALHRISYLLYWHEQVXPKDILILAPNEIFLSYIKDIVPEI
EIEGIEQRTFYDWASTYFTDVHDIPDLHEQYVHIYGSTEKEDLIKIAKYKGSLRFKKLLD
DEVEYIGNTNIPHGDVVIESGVILSKEEIHQFYHAKEHLPLNVRNKEVKEFIINWRNEQI
NIRKQQIEDEFEEAYRKWVVTLPEGEERKAVYEALEKAKQLRMKIFQEKNQHEISLIVKK
MENIPALLNYKSVFQKKVFEKFHPDIDEELLSLLLKNGRQIKQERFMYEDIAPLIYLDAK
INGKKLWEHIVIDEAQDYSPFQLAINKDYAKSMTILGDIAQGIFSFYGLDRWEEIESYV
FKEKEFKRLHLQTSYRSTKQINDLANRVLLNSNIDEPLVIPVNRPGDVPTIKKVESIGEL
YDEIVNSIRIFEEKGYKKIAILTASKQGAIDTYDQLNRRQITQNEVITEGHQALKEKIVI
IPSYLVKGLEFDAVIIEDVSDETEKDETQHAKMLYNSITRAHHDLHLFYRGNISPLLEER
DPSAPPKPRKSFADWLITDINDPYVEPQVEAVKRVKKEDMIRLFDDEEEEFVEEAFEDDR
ERYYDFHAWLKVWRRWAEMRKQLDEKS >tr|B5Y6N2|B5Y6N2_COPPD DNA helicase OS = Coprothermobacter
proteolyticus (strain ATCC 35245/DSM5265/DT) GN = perA PE = 4
SV = 1 (SEQ ID NO: 91)
MALPQENLIPPSPSHNHLTLSLRSHIGGFFIYNEDVDSVDLSKLNEAQKQAVTAPPKPLA
IIAGPGSGKTRVLTYRALFAVKEWHLPPERILAITFINKADELKERLGRLIPEGDRIFA
ATMHSFAARMLRYFAPYAGISQNFVIYDDDDSKGLIEDILKQMNFIDTKRFRPNDVLNHIS
AAKARMFDCNTFPEFIRQRYGSWGITYFDTVHQVFMTITERLKEQSQALDFDDLIMVLAQRN
EDRPELRENTAGLFDLVMVDEFQDINFAQYQNLLYNTNPHYSGMNNVTIVGDPDQSIYGF
RAAETYNIKRFIDDYNPEVVELDLNIRSNRTIVDSASALINDSPSALFERKLESIKGAGN
KLILRRPFDDADAAITAAFEVQRLHKNGIPYEEIAVLMRTRALTARVEREFATRNIQYEI
IGGVPFFARRETKDILAYLRLSRNAMDRVSLKR:ILTMKKRGFGTABLEKLENFAEENKLT
LLEAMKAAVESLLFKKLSMNDYLESLYTLIQTIQEIAEPSQAIYLVNEUNLLDHFRSIS
KSEEEYIERTENVKQLISIAEESADMDDFLQRSALGTRENNGGVEVGVAISTVHGVKGLEF
```

TABLE 18 -continued

QAVILYYVTDGFFPHSLSVITAEKEEERRLLYVAMTRAKEHLIFYVPYKQPWGNGFEQMA
RPSPFLRSIPKELWDGKPNEIESLYAPYBPQQKWSE

>tr|D7BJL0|D7BJL0_MEISD DNA helicase OS = Neiothermus sjivanus
(strain. ATCC 700542/DSM9946/VI-R2) GN = Mesil 3574 PE = 4
SV = 1 (SEQ ID NO: 92)
MNDPIRHKEGPALVFAGAGAGKTRILTQRVKWLVEEGEDPYSITLVTFINKAAGEMKERI
ARLVEAPLAEAVWVGTFHRFCLQSLQVYGREIGLEKVAVLDSAAQRKLAERIIAGLFPAK
PPRGFIPMAALGAVSRAANSGINDDIQLATMYADLTEKIVNERWAYEEAKKGLGALDYDDL
LLRGVRLLKLSEGAARMVRRRAAYLMVDEFQDINGVQLELVRAIAPGISPNLMVVGDPDR
SIYGWRGANYRTILEFRQHYPGAAVYGLYTNYRSQAGVVEVANRIIAQNATRKPEMQEAH
LPQSEEPFLLVAKNRWEEAHFVAQAVEFYRGQGIALEENAVLNRANFLSRDLEQALRLRG
IPYQFTGGRSFFERREIQLGMAVLKVLANPKDSLAVAALVEEMVEGAGPLGIQKVLEAAK
AANLSPLEAFRNPAMVKGLRGKEVQAEANRLAEVLQDQVARLAAEAPEYHALLKEILDRL
STEAWIDRLGEESEQVYERKANLDRLLQGMQEWQEVNPGAPLQDLVGILLLEAGDIPAEE
GQGVHLNIVHASKGMEFRVVEVIGLNEGLFPLSKASSSFEGLEEERRLNYVAV7RAKEVL
HLSYAADGVVSRFAQEARVPVEEYDPRIGWSGRQNQQALKALLEIA >tr|E8MZN5|E8MZN5_ANATU DNA helicase OS = Anaerolinea
thermophila (strain DSM14523/JON11388/NBRC 100420/UNI-1)
GN = perA PE = 4 SV = 1 (SEQ ID NO: 93)
MDSLEHLNPQQRAAVIASAGPVLVLAGPGSGKTRVITFRIGYLLSQLGVAPHHILAVIFT
NKAARENQSRVEKLLGHSLQGMWLGTFHAICARdLRREQQYLPLDANEVIEDEDDQQALT
KRALRDLNLDEKLYRPTSVHAAISNAKNNLILPEDYPTATYRDEVVARVYKRYQELLVSS
NAVDFDDLLLYAWKLLNEFSTVREQYARRFEHILVDEFUTNLAQYELVKLLASYHRNLF
VVGDEDQSIYRWRGADYRNVLRFEEDFPDRQKILLEQNYRSTQRVLDAAQAVINRNRNRI
PKRLKSTPEHGEGEKLVLYEAVDDYGEAAFVVDTIQQLVAGGKARPGDFAIMYRTNAQSR
LLEEAFLRAGVPYRLVGANRFYGRREVKDMIAYLRLVQNPADEASLGRWINVPPRGIGDK
SQLALQMEAQRTGRSAGLILMELGREGKDSPHWQAIGRNAELLADEGSLLGEWHRIKDEI
SLPSLFQRILNDLAYREYTDDNTEEGQSRWENVQELLRIAYEYEEKGLTAFLENLALVSD
QDTLPENVEAPTLLTLHAAKGLEFPIVFITGLDDGLIPHNRSLDDPEANAEERRLFYVGL
TRAKKRVYLVRA_AQRSTYGSFQDSIPSRFLKDIPADLIQUGRGRRNGRSWQSESRRSWD
DNYAGTWGSRPERAKPSHAPILQPRFKPGMRVKHPSWGEGLVVDSRIQDEDETVDIFFDS
VGFKRVIASIANLEILS >tr|L0INW7|L0INW7_THEIRATP-dependent exoDNAse (Exonuclease
V), alpha subunit/helicase superfamily Imember
OS = Thermoanaerobacterium thermosaccharolyticum M0795
GN = Thethe 02902 PE = 4 SV = 1 (SEQ ID NO: 94)
MDINGQIIKLNRNKTQGTLKLINGQKIKFKINSDSVKPIFLYEYYKFKGNMIEDTLIIDD
IYGIANDININDFIELFPSVAHDKINNICNRENVLHVGNLIDLINDENFITVVNDTIGEE
KATIFLSNLQKIKDRQEYIDVWDIIKKINPTEDINVPIKIVNALKYRASMNNITVSQLIK
ESPWIIEQLDIFDSITERKKIAENIATHYGLSNDSNKAVISYAIAMTNNYIQQGHSYIPY
YILVSRVSNSLKLDENKVNDTLKFLPNDNKSGYLIRDNKYKDFIENFYNSDKKIGYSVYL
PKIEHMEKYIADIISSILKKKSTINKIELQKNLKLYRSENKLIFSKEQEFAIFSISDNKI
TVITGGAGTGKITVIKAIIDLVNKMGYIPVVLAPTGIASQRVAPNVGSTIHKYARIFDTY
DPVEDEIEENKENNSGKVIIVDEMSMITVPVFAKLLSVILDADSFIFVGDPNQLPPIGAG
GVFEALIELGNKNINNINTVVLNQSFRSKNSIVXNAQNILEDKPIYEDDNLNIIEAKSWN
KIADEVVNLIRKILDNGVQYSDIMVLSSKRGEGKNGVELLNERIRKEIENNKGKYAVGDI
VITIRNDYDNKSSYFRSKELKKYINSIRHEERPTIENGTVGVIKDISDNEVIIEYNTPMP
VEAKYNMEFLDWYIEYGFAITVHKAQGGQAKYIIFASDEPRNISREMLYTAITRCKNGKV
FLIGGENEDWKIKKEHSFVLSKLKYRILDNIHQOEKESKINSKIVLINQ >tr|D3PR99|D3PR99_MEIRD DNA helicase OS = Meiothermus ruber
(strain ATCC 35948/DSM1279/VKMB-1258/21) GN = K649 05745
PE = 4 SV = 1 (SEQ ID NO: 95)
MSDLLSSLNPSQQEAVLHFEGPALVVAGAGSGKTRIVVHRIAYLLRERRVYPAEILAVTF
TNKLAGEMKERLEKMVGRPARDLWVSTFHAAAVRILRTYGEYVGLRPGFVIYDEDDQNTL
LKEVLKELELEAKPGPFRAMIDRIKNRGAGLAEYMREAPDFIGGVPKDAAAEVYRKYQSG
LRMQGALDENDLLLLTIELFEQHPEVLHKVQQRARFIHVDEYQDTNPVQYKLTRLLAGER
PNLMVVGDPDQSIYGERSADINNILDFIKDYPGARVIRLEENYRSSSSILRVANAVIEKN
ALRLEKVLRPTRPGGEPVRLYRAPNAREEAAFVAREIVKLGNEXIAVLYRINAQSRLLE
FHLRRANVPVRIVGAVGFFERREIKDLLAYGRVAVNPADSINLRRIVNIPPRGIGATIVS
RLVEHAQKTGTIVFEAFRVAEQVISRPQQVQAFVRLLDELIEAAFESGPTAFFQRVLEQT
GFREALKQEPDGEDRLQNVEELLRPAQDWEEEEGGSLSDFLDSVALTAKAEEPQGDAPAE
AVTLMILHNAKGLEFPTVFLVGLEENLLPHRNSLHRLEDLEEERRLFYVGITRAQERLYL
SYAEERETYGKREYIRPSRFLEDIPQDLLKEVGAFGDSEVRVLPQARPEPKPRIQLAEFK
GGEKVRHPKEGSGIVVAAMGGEVIVMFPGVGLKRLAVKFAGLERLE >tr|D3PLL2|D3PLL2_MEIRD DNA helicase OS = Meiothermus ruber
(strain ATCC 35948/DSM1279/VIMB-1258/21) GN = K649 10770
PE = 4 SV = 1 (SEQ ID NO: 96)
MKVRVASAGTGKIASLVLRYLELIAKGIPLRRIAGVTFTRKAADELRVRVAAAIEEVIQT
GRELSEVASGGSRAAFQEAAREIAGATLSTIHGEMAQCLRLAAPILHLDPDFSMLGDWEA
QAIFFEEWQTLRYLAQDAHHPLEGLVSDFLTEPLLHLFSRRSQAEVFEPAAGEANQHLLQ
VYQTVYAAYEARLGANLLSPSELERKALFLARNDRAMKRVLERVRVLLVDEYQDVNPVQG
AFFLALEQARLPIEIVGDPKQSIYAFRNADVSVERKALREGKSEPPLIHSYRHSRVLVRF
LNGLIGYLAKEGLGEGLEEAPPVEGVRPEQGRLEVHWVVGELPLEELRKQEARVLAGRLA
ALRGPIEYSQMAVLVRSYGSVRFLEEALAEAQIPYVLLQGRGYYERQEVRDLYHALRAAL
DPRGLSLAVFLRSPFGQHTEAGPLKPLELPQIEGVIRADDPLGRLAQHWPSVYERLRQIQ TABLE 18 -continued

```
AQVRLMAPLEVLKFLIRAPLMDGRPYHDFLEPRARENVDALLFYFAPRPPQNLEGLLERL
ELLSRQADAGDVPQSGEGVQILIVHQAKGLEWPLVAVEDLGRMNVHRPQPLYIGQPNGG
DGGRLRRWVALPETPQFEAFRQQVKLUEEESYRLLYVAASRARDILLLTASASHGQPEG
WGKVLEAMNLGPASKPYHRPDFHLQIWPYQPAPPVRVLSQPAPLQPSPWVDARFEPEPFP
PLFSPSALKRLEAEPLPLPDPEEGEAVPGRARAIGILVHYAIGQNWRPDNPQHLANLEAQ
EVMFPFGPDERRGIMAEVQALLEHYQELLGRALPWPRDEDYPEFAVALPLGSTVWQGVID
RLYRVGQQWYLEDYKTDQEMRPERYLVQLGIYLAAIRQAWQIEPEVRLVYLRFGWVERLD
KAILEAALGEIMPKGEGIRR

>tr|Q9RTI9|0RTI9_DEIRA DNA helicase OS = Deinococcus
radiodurans (strain ATCC 13939/DSM20539/JON16871LMG
4051/NBRC 15346/NCIMB 9279/R1/VKMB-1422) GN = DR 1775
PE = 4 SV = 1 (SEQ ID NO: 97)
MTSSAGPDLLQALNPTQAQAADHFTGPALVIAGAGSGKIRTLIYRIAHLIGHYGVHPGEI
LAVTFINKAAAEMRERAGHLVPGAGDLWMSTEHSAGVRILRTYGEHIGLRRGEVIYDDDD
QLDIIKEVMGSIPGIGAETURVIRGIIDRAKSNLWTPDDLDRSREPFISGLPRDAAAEA
YRRYEVRKKGQNAIDEGDLITETVRLFKEVPGVLDKVQNKAKFITHVDEYQDTNRAQYELT
RLLASRDRNLLVVGDPDQSIYKFRGADIQNILDFQKDYPDAKVYMLEHNYRSSARVLEAA
NKLIENNTERLDKILKPVKEAGQPVTFHRATDHRAEGDYVADWLTRLHGEGRAWSEMAIL
YRTNAQSRVIEESLRRVQIPARIVGGVGFYDRREIRDILAYARLALNPADDVALRRIIGR
PRRGIGDTALQKLMEWARTHHTSVLTACANAAEQNILDRGAHKATEFAGLMEAMSEAADN
YEPAAFLRFVMETSGYLDLLRQEGQEGQVRLENLEELVSAAEEWSQDEANVGGSIADFLD
DAALLSSVDDMRTKAENKGAPEDAVTLMILHNAKGLEFPVVPIVGVEQGLLPSKGAIAEG
PSGIEEERRIFYVGITRAMERILMTAAQNRMUGKINAAEDSAFLEDIEGLFDTVDPYGQ
PIEYRAKTWKQYRPTVRAATTAVKNTSPLTAELAYRGGEQVKHPKFGEGQVLAVAGVGER
QEVTVHFASAGIKKLMVKFANLTKL >tr|M1E5C5|M1E5C5_9FIRM DNA helicase OS = Thermodesulfobium
narugense DSM14796 GN = Thena 1375 PE = 4 SV = 1 (SEQ ID NO: 98)
MDLNLNEDQKRAVYSDSRALLIVAGAGTGKTRVLTTRAARLIKENPDARYLLLIFTKKAA
REMTTRVRELIEEDTKNRLYSGTEHSFCSNIIRRRSERVGLINDFVIIDESDSLDLMKKV
FSRIYSKEKIDSLIFKPKDILSLYSYARNNNQDFIEIVQRKYKYVNFEDIKKIISLYELN
KKERNYLDFDDLLMYGLLAIKTLEKSPFDEVLVDEFUTNQIQAEMLYYFYDLGSRISAV
GDDAQSIYSFRGAYYENMENYIKRLDAEKlILSSNIRSTQQILDIANSIIQSSYSSIKKE
LVANVRLKENVKPKLVIVSDDWEEARYVAREMQKFGEKGLKVAALYRAAYIGRNLESQLN
SMGIKYSFYGGQKLTESAEAKDFMSFLRVEVNPKDEIALIRTLKMFPGIGEKKAFKIKDA
VISGDNLKKALSKEKNLEELNIFFDKLFKITDWHDLLELVFDFYKDIMNRLYPENYEERE
EDLIKEMDMSSNYDNLVEYLEAFTLDPVEKSEFDNNNVILSTIHSAKGLEFDVVFLLSVI
ESVYPHFRAQSTDEIEEERRLFYVAITRAKQRLIFTFPRHSKKSRGYFAKNTISPFLREK
DNYLEVFIAR >tr|O5IE7|Q5SIE7_THET8 DNA helicase OS = Thermus thermophilus
(strain. HB8/ATCC 27634/DSM579) GN = T1HA.1427 PE = 4 SV = 1 (SEQ
ID NO: 99)
MSDALLAPLNEAQRQAVLHFEGPALVVAGAGSGKTRIVVHRVAYLVARRGVEPSEILAVT
FINKAAEEMRERLRGLVPGAGEVWVSTFHAAALRILRVITGERVGLRPGFVVYDEDDQTAL
LKEVLKELALSARPGPIKALLDRAKNRGVGLKALLGELPEYYAGLSRGRLGDVLVRYQEA
LKAQGALDFGDILLYALRLLEEDEEVLRLVRKRARFIHVDEYQDTSPVQYRFTRLLAGEE
ANLMAVGDPDQGIYSFRAADIKNILDFTRDYPEARVYRLEENYRSTEAILRFANAVIVKN
ALRLEKALRPVKRGGEPVRLYRAEDAREEAREVAFETARLGPPWDRYAVLYRTNAQSRLL
EQALAGRGIPARVVGGVGFFERAEVKDLLAYARLALNPLDAVSLKRVLNIPPRGIGPATW
ARVQLLAQEKGLPPWEALKEAARTFSRPEPLRHEVALVEELQDLVEGPAEAFFRHLLEAT
DYPAYLREAYPEDAEDRLENVEELLRATIKEAEDLQDFLDRVALTAKAEEPAEAEGRVALM
TLHNAKGLEFPVVELVGVEEGILPHRNSVETLEGLEEERRLFYVGITRAQERLYLSHAEE
REVYGRREPARPSRFLEEVEEGLYEVYDPYRRPPSPPPHRPRPGAFRGGERVVEPREGPG
TVVAAQGDEVIVEFEGFGLKRLSLKYAELKPA >tr|B5YD55|B5YD55_DICT6 DNA helicase OS = Dictyogiomus
thermophilum (strain ATCC 35947/DSM3960/H-6-12)
GN = DICTH_0581 PE = 4 SV = 1 (SEQ ID NO: 100)
MNNQFDSEKKIFIIPSRKKKEFLERIEKDLNEEQRKVVLEADGPSLVIAGPGSGKTRTIV
YRVGYIVALGYSPKNIMLLTFTNQAARHMINRTQALIRESIEEIWGGIFEHVGNRILRVY
GKIIGINEQYNILDREDSLDLIDECLEELFPEENLGKGILGELFSYKVNIGKNWDEVLKI
KAPQIIDKIEIVQKVFERYEKRKRELNVLDYDDLLFTWYRLLLESEKTRKILNDRELYIL
VDEYQDTNWLQGEIIRLTREENKNILVVGDDAQSIYSFRGATIENILSFPEIFPGTRIFy
LVFNYRSTPEIINLANEIIKRNTRQYFKEIKPVLKSGSKPKLVWVRDDEEEAQFVVEVIK
ELHKEGVKYKDIGVLERSNYHSMAVQMELTLQGIPYEVRGGLRFFEQAHIKDMISLLKIL
FNEWEISAQRFFKLFPGIGRAYAKKLSQVLKESKDFDKIFQMUSGRTLEGLRILKNIW
DKIKVIPVQNFSEILRVFFNEYYKDYLERNYPDFKDREKDVDQLILLSERYDDLEKPFLSE
LTLYTYAGEKLLEEEEEEKDFVVLSTIHQAKGLEWHAVFILRLVQGDEPSYKSMDNIEEE
RRLFYVAVTRAKRELYVITYLTRKVKDMNVFTKPSIFLEELPYKELFEEWIVQREI >tr|F6DJA4|F6DJA4_THETG DNA helicase OS = Thermus thermophilus
(strain SG0.5JP17-16) GN = Ththe16_124 PE = 4 SV = 1
(SEQ ID NO: 101)
MLSPFGGEEETKAIPLEFEILLAWRVFSAALPPNFLAPVSASLHILVREAEGKEGAELEA
YAWERLEELARTSVVKDAIQSFLEVAAEKPEVLRAGLLWFRTWNRLSPEEREALYRKAER
FKPTAELASKASFLQGPPPPPKPLSPSVQAARSSPPRFTPTPEQEEAVRAFLSREDMKLV
AVAGSGKITTLRLMAQSAPKERLLYVAFNRSVRDEAERTFPGNVEVTLHGLAHRHVVRG
SGAYQRKLAARNGRVTPGDV-LEALELPRERYALAYVIRSTLEAFLRSASEVPIPAHIPPE
```

TABLE 18 -continued

YREVLQRRDKDPFSERYVLKAVRLIWKLMQDPDDSFPLSEDGFVKIWAQAGAKIRGYDAY
LVDEAQDLSPVFLQNLEAERGELRRVYVGDPRQQTYGWRGAVNAMDKLDAPERKLIWSFR
FGEDLARGVRRFLAHVGSPIELHGKAPWDTEVSLARPEPPYTALCRTNAGAVEAVISFLL
EEGREGARVEVVGGVDEIANLLRDAHLLKVGGEREKPHPELALVENWEELEELAKEVNHP
QARMLVRLARRYDLLELARLLKHAQADEEGKADLVVSTLHKAKGREWDRVVLWGDFIPVW
DEKVREFYRKQGALDELKEEENVVYVALTRARRFLGLDQLPDLHERFFQGEGLVKPPSVS
PLSVGGAGVSADLLRELEVRVLAKLEDRLKEVAEVLAALLVEEASKAVAEAMREMGLLGE
EG

>tr|F6DIL2|F6DIL2_THETG DNA helicase OS = *Thermus thermophilus*
(strain SG0.5JP17-16) GN = Ththe16_1438 PE = 4 SV = 1 (SEQ ID NO:
102)
MSDALLAPLNEAQRQAVLHFEGPALVVAGAGSGKTRTVVERVAYLVARRGVEPSEILAVT
FINKAAEEMRERLRGIVPGAGEVWVSTFHAAALRILRVYGERVGLRPGFV-VIDEDDQTAL
LKEV-LKELALSARPGPIKALLDRAKNRGVGLKALLGELPETYAGLSRGRLGDVLVRYQEA
LKAQGALDFGDILLYALRLLEEDEEVLRLVRKRARFIHVDEYQDTSPVQYRFIRLLAGEE
ANLMAVGDPDQGIYSFRADIKNILDFTRDYPEARVYRLEENYRSTEAILRFANAVIVKN
ALRLEKALRPVKRGGEPVRLYRAEDAREEARFVAEEIARLGPPWDRYAVLYRTNAOSRLL
EQALAGRGIPARVVGGVGFFERAEVKDLLAYARLALNPLDAVSLKRVLNTPPRGIGPATW
ARVQLLAQEKGLPPWEALKEAARTFPRAEPLRHEVALVEELQDLVEGPAEAFFRHLLEAT
DYPTYIREATPEDAEDRLENVEELLRAAKEAEDLQDFLDRVALTAKAEEPAEAEGKVALM
TLHNAKGLEFPVVELVGVEEGLLPHRNELSTLEGLEEERRLFYVGITRAQERLYLSHAEE
REVYGRREPARPSRFLEEVEEGLYEVVDPYRRPPSPPPHRPRPGAFRGGERVVHPREGPG
TVVAAQGDEVTVHFEGVGLKRLSLKYAELKPA >tr|F6DJ67|F6DJ67_THETG DNA helicase OS = *Thermus thermophilus*
(strain SG0.5JP17-16) GN = Tnthe16_2078 PE = 4 SV = 1(SEQ ID NO:
103)
MEANLYVAGAGIGKTYTLAERYLGFLEEGLSPLQVVAVIFTERAALELRHRVRQMVGERS
LGHKERVLAELEAAPIGTLHALAARVCREFPPEAGVPADFQVMEDLEAALLLEAWLEEAL
LEALQDPRYAPLVEAVGYEGLLDTLREVAKDPLAARELLEKGLGEVAKALRLEAWRALRR
RMEELFHGERPEERYPGFPKGWRTEEPEVVPDLLAWAGEVKFNKKPWLEYKGDPALERLL
KLLGGVKEGFSPGPADERLEEVWPLLRELAEGVLARLEERRFRARRLGYADLEVHALRAL
EREEVRAYYRGRFRRLLVDEFQDTNPVQVRLLQALFPDLRAWTVVGDPNQSIYSFRRADP
KVMERTQAEAAKEGLRVRRLEKSHRYHQGLADEHNRFFPPLLPGYGAVSAERKPEGEGPW
VEHFQGDLEAQARTIAQEVGRILSEGFQVYDLGEKAYRPMSLRDVAVLGRTWRDLARVAE
ALRRLEVPAVEAGGGNLLETRAFKDAYLALRFLGDPKDEEALVGLLRSPFFALTDGEVRR
LAEARGEGETLWEVLEREGDLSAEAERARETLRGLLRRKALEAPSRLLQRLDGATGYTGV
AARLPQGRRRVKDWEGILDLVRKLEVGSEDPFLVARHLRLLLRSGLSVERPPLEAGEAVT
LLTVHGAKGLEWPVFVEVLNVGGWNRLGSWKNNKTKPLFRPGLALVPPVLDEEGNPSALFH
LAKRRVEEEEKQEENRLLYVAATRASERLYLLLSPDLSPDKGDLDPQTLIGAGSLEKGLE
ATEPERPWSGEEGEVEVLEERIQGLPLEALPVSLLPLAARDPEAARRRLLGEPEPEGGEA
WEPDGPQETEEEVPGGAGVGRMTHALLERFEAPEDLEREGRAFLEESFPGAEGEEVEEAL
RLARTFLTAEVFAPYRGNAVAKEVPVALELLGVRLEGRADRVGEDWVLDYKTDRGVDAKA
YLLQVGVYALALGKPRALVADLREGKLYEGASQWEEKAEEVLRRLMGGDRPEA >tr|G8N9P8|G8N9P8_9DEIN DNA helicase OS = *Thermus sp.*
CCB_US3_UF1 GN = TCCBUS3UF1_17030 PE = 4 SV = 1 (SEQ ID NO: 104)
MDAFPSGKPLDEAWLSSLNEAQRQAVLHFEGPALVVAGAGSGKTRIVVHRVAYLMARRGV
YPSEILAVTFTNKAEEMRERLKAMVKGAGELWVSTFHAAALRILRFYGERVGLKPGFVV
YDEDDQTALLKEVLKELGVSAKPGPIKALLDRAKNRGEPPERLLADLPEYYAGLSRGRLL
D-VLHRYQQALWAQGALDFGDILLLALKLLEEDPEVRKVRKRARFIHVDEYQDTSPVQYR
LTKLLAGEEANLMAVGDPDQGIYSFRAADIKNILUTEDFPGAKVIRLEENYRSTERILR
FANAVIVKNALRLEKTLRPVKSGGEPVRLFRARDAREEAREVAEEVLRLGPPYDRVAVLY
RTNAQSRILEQALASRGIGARVVGGVGFFERAEVKDLLAYARLALNPLDAVSLKRVLNIP
PRGIGPATVEKVQAIAQEKGLPLYEALKVAAQVLPRPEPLRHFLALMEELMDLAFGPAEA
FFRHLLEATDYPAYLKEAYPEDLEDRLENVEELLRAREAEGLMDFLDKVALTARAEEPG
EAGGKVALMTLHNAKGLEFPVVFLVGVEEGLLPHRSSVSTLEGLEEERRLFYVGVTRAQE
RLYLSYAEEREVYGRPEASRPSRFLEEVEEGLYEEYDPYRLPPPKPVPPPHRAKPGAFRG
GEKVVHPRFGLGTVVAASGDEVIVHFDGVGLKRLSLKYADLRPA >tr|Q1J014|Q1J014_DEIGD DNA helicase OS = *Deinococcus
geothermalis* (strain DSM11300) GN = Dgeo_0868 PE = 4 SV = 1
(SEQ ID NO: 105)
MPDLPASSLLAQLNPNQAQAANHYTGPALVIAGAGSGKIRTLVYRIAHLIGHYGVDPGEI
LAVTFINKAAAEMRERARHLVEGADRLWMSTEESAGVRILRAYGEHIGLKRGEVIYDDDD
QLDILKEIMGSIPGIGAETHPRVLRGILDRAKSNLLTPADLARHPEPFISGLPREVAAEA
YRRYEARKKGQNAIDEGDLITETVRLFQEVPAVLERVQDRARFIHVDEYQDTNKAQYELT
RILASRDRNLLVVGDPDQSIYRFRGADIQNILDFQKDYLDAKVYMLEQNYRSSARVLTIA
NKLIENNAERLEKTLRPVKEDGHPVLEHRATDQRAEGDEVAEWLIRLHAEGMRFSDMAVL
YRTNAQSRVIEESLRRVQIPAKIVGGVGFYDRREIKDVLAYARLAINPDDDVALRRIIGR
PKRGIGDTALERLMEWARVNGTSILTACAHAQELNILERGAQKAVEFAGLMHAMSEAADN
DEPGPFLRYVIETSGYLDLLRQEGQEGQVRLENLEELVSAAEEWSRENEGTIGDFLDDAA
LLSSVDDMRTKQENKDVPEDAVTLMTLHNAKGLEFPVVFIVGTEEGLLPSKNALLEPGGI
EEEERRLFYVGITRAMERLFLTAAQNRMQYGKTLATEDSRFLEEIKGGFDTVDAYGQVIDD
RPKSWKEYRPTESARPGAVKNTSPLTEGMAYRGGEKVRHPKFGEGQVLAVAGLGDRQEVT
VHFPSAGTKKLLVKFANLTRA TABLE 18 -continued

```
7>tr|Q745W4|O45W4_THET2 DNA helicase OS = Thermus thermophilus
(strain HB27/ATCC BAA-163/DSM7039) GN = TT_P0191 PE = 4 SV = 1
(SEQ ID NO: 106)
MALRPTEEQLKAVEAYRSGQDLKVVAVAGSGKITTLRIMAEATPGKRGLYLAFNRSVQQE
AARKFPRNVRPYTLHALAFRMAVARDEGYRAKFQAGKGHLPAQAVAEALGLRNPLLLHAV
LGTLEAFLRSEAASPDPGMIPLAYRTLRAGIKTWPEEEAFVLRGVEALWRRMTDPKDPFP
LPHGAYVKLWALSEPDLSFAEALLVDEAQDLDPIFLKVLEAHRGRVQRVYVGDPRQQIYG
WRGAINAMDRLEAPEARLTWSFRFAETLARFVRNLTALQDRPVEVRGKAPWATRVDAALP
RPPFTVLCRTNAGVVGAVVVTHEVHRGRVEVVGGVEELVHLLRDAALLKKGEKRTDPHPD
LAMVETWEELEALAEAGYAPAYGVLRLAQEHPDLEALAAYLERAWTPVEVAAGVVVSTAE
KAKGREWDRVVLWDDFYPWWEEGWRVNWGSDPAHLEEENLLYVAATRARKHLSLAOIR
DLLEAVDRMGVYRVAEEATRAYLLLSAEVLRGVATDPRVPAEHRVRALKALGYLERGEEA
LDSPGKPGGQG >tr|Q721S0|021S0_THET2 DNA helicase OS = Thermus thermophilus
(strain HB27/ATCC BAA-I63/DSM7039) GN = uvrD PE = 4 SV = 1
(SEQ ID NO: 107)
MSDALLAPLNEAQRQAVLHFEGPALVVAGAGSGKTRIVVHRVAYLVARRGVEPSEILAVT
FINKAAEEMRERLRGLVPGAGEVWVSTFHAAALRILRVYGERVGLRPGFVVYDEDDQTAL
LKEVLKELALSARPGPIKALLDRAKNRGVGLKALLGELPEYYAGLSRGRLGDVIVRYQEA
LKAQGALDFGDILLYALRLLEEDEEVLRLVRKRARFIHVDEYQDTSPVQYRFTRLLAGEE
ANLMAVGDPDQGIYSFRAADIKNILDFTRDYPEARVYRLEENYRSTEAILRFANAVIVKN
ALRIEKALRPVKRGGEPVRIYRAEDAREFAREVAEEIARIGPPWDRYAVLYRTNAQSRLL
EQALAGRGIPARVVGGVGFFERAEVKDLLAYARLALNPLDAVSLKRVLNIPPRGIGPATW
ARVQLLAQEKGLPPWEALKEAARTFPRPEPLRHEVALVEELQDLVEGPAEAFFRHLLEAT
DYPAYLREAYPEDAEDRLENVEELLRAAKEAEDLQDFLDRVALTAKAEEPAEAEGRVALM
TLHNAKGIEFPVVELVGVEEGLLPHRNEVSTLEGLEEERRLFYVGITRAQERLYLSHAEE
REVYGRREPARPSRFLEEVEEGLYEVYDPYRRPPSPPPHRPRPGAFRGGERVVHPRFGPG
TVVAAQGDEVIVEFEGFGLKRLSLKYAELKPA >tr|F2NK78|F2NK78_MARHT DNA helicase OS = Marinithermus
hydrothermalis (strain DSM14884/JCM11576/TI)
GN = Marky_1312 PE = 4 SV = 1 (SEQ ID NO: 108)
MDLLRDLNPAQREAVQHYTGPALVVAGAGSGKTRTVVERIAYLIRHRGVIPTEILAVTFT
NKAAGEMKERLARMVGPAARELWVSTFHSAALRILRVIGEYIGLKPGFVVYDEDDQLALL
KEVIGGLGLETRPQYARGVIDRIKNRMWSVDAFLREAEDWVGGLPKEQMAAVYQAYEARM
RALGAVDMDTDLKVIGLFEABPEVLHRVQQRARFIHVDEYQDINPAQYRLTRLLAGAER
NLMVVGDPDQSIYGFRNADIHNILNFEKDYPDARVYRLEENYRSTEAILRVANAVIERNA
LRLEKTLRPVRSGGDPVFLYRAPDHREEAAFVAREVQRLKGRGRRLDEAVLYRTNAQSR
VLEEAFRRQNLGVRIVGGVGFYERREVKDVLAYARAAVNPADDLAVKRVLNVPARGIGQT
SLARDSQLAETARVSFFEALRRAGEVLARPQAQAVQRFVALIEGLANAAYDIGPDAFIRL
VLAEIGYADMLRREPDGEARLENLEELLRAAREINEEQHAGIIADFLDEVALTARAEEPEG
EVPAEAVILMILHNARGLEETVVFIVGVEEGLLPHRSSTARVEDLEEERRLFYVGIRAQ
ERLYLILSEEREIYGRREAVRASREILEDIPEAFLQPLSPFGEPLGAGREPVAVRPTRRSS
AAGGFRGGEKVRHPRFGQGLVVAASGEGDRQEVIVEIFAGVGLKKLLVKYAGLERIEL
```

REFERENCES

1. B. Choi, G. Zocchi, Y. Wu, S. Chan, L. Jeanne Perry, Allosteric control through mechanical tension. *Phys Rev Lett* 95, 078102 (2005).
2. M. Volgraf et al., Allosteric control of an ionotropic glutamate receptor with an optical switch. *Nat Chem Biol* 2, 47-52 (2006).
3. M. Tomishige, R. D. Vale, Controlling kinesin by reversible disulfide cross-linking. Identifying the motility-producing conformational change. *J Cell Biol* 151, 1081-1092 (2000).
4. B. Schierling et al., Controlling the enzymatic activity of a restriction enzyme by light. *Proceedings of the National Academy of Sciences of the United States of America* 107, 1361-1366 (2010).
5. D. M. Veine, K. Ohnishi, C. H. Williams, Jr., Thioredoxin reductase from *Escherichia coli*: evidence of restriction to a single conformation upon formation of a crosslink between engineered cysteines. *Protein science: a publication of the Protein Society* 7, 369-375 (1998).
6. T. M. Lohman, E. J. Tomko, C. G. Wu, Non-hexameric DNA helicases and translocases: mechanisms and regulation. *Nat Rev Mol Cell Biol* 9, 391-401 (2008).
7. A. Niedziela-Majka, M. A. Chesnik, E. J. Tomko, T. M. Lohman, *Bacillus stearothermophilus* PcrA monomer is a single-stranded DNA translocase but not a processive helicase in vitro. *The Journal of biological chemistry* 282, 27076-27085 (2007).
8. T. Ha et al., Initiation and re-initiation of DNA unwinding by the *Escherichia coli* Rep helicase. *Nature* 419, 638-641 (2002).
9. B. Sun et al., Impediment of *E. coli* UvrD by DNA-destabilizing force reveals a strained-inchworm mechanism of DNA unwinding. *The EMBO journal*, (2008).
10. W. Cheng, J. Hsieh, K. M. Brendza, T. M. Lohman, *E. coli* Rep oligomers are required to initiate DNA unwinding in vitro. *Journal of molecular biology* 310, 327-350 (2001).
11. N. K. Maluf, C. J. Fischer, T. M. Lohman, A Dimer of *Escherichia coli* UvrD is the active form of the helicase in vitro. *Journal of molecular biology* 325, 913-935 (2003).
12. M. S. Dillingham, Superfamily I helicases as modular components of DNA-processing machines. *Biochemical Society transactions* 39, 413-423 (2011).
13. M. Yamaguchi, V. Dao, P. Modrich, MutS and MutL activate DNA helicase II in a mismatch-dependent manner. *The Journal of biological chemistry* 273, 9197-9201 (1998).

14. L. E. Mechanic, B. A. Frankel, S. W. Matson, *Escherichia coli* MutL loads DNA helicase II onto DNA. *The Journal of biological chemistry* 275, 38337-38346 (2000).
15. P. Soultanas et al., Plasmid replication initiator protein RepD increases the processivity of PcrA DNA helicase. *Nucleic acids research* 27, 1421-1428 (1999).
16. A. F. Slatter, C. D. Thomas, M. R. Webb, PcrA helicase tightly couples ATP hydrolysis to unwinding double-stranded DNA, modulated by the initiator protein for plasmid replication, RepD. *Biochemistry* 48, 6326-6334 (2009).
17. P. Soultanas, M. S. Dillingham, D. B. Wigley, *Escherichia coli* ribosomal protein L3 stimulates the helicase activity of the *Bacillus stearothermophilus* PcrA helicase. *Nucleic acids research* 26, 2374-2379 (1998).
18. J. E. Yancey, S. W. Matson, The DNA unwinding reaction catalyzed by Rep protein is facilitated by an RHSP-DNA interaction. *Nucleic acids research* 19, 3943-3951 (1991).
19. S. Barranco-Medina, R. Galletto, DNA binding induces dimerization of *Saccharomyces cerevisiae* Pif1. *Biochemistry* 49, 8445-8454 (2010).
20. H. S. Subramanya, L. E. Bird, J. A. Brannigan, D. B. Wigley, Crystal structure of a DExx box DNA helicase. *Nature* 384, 379-383 (1996).
21. S. Korolev, J. Hsieh, G. H. Gauss, T. M. Lohman, G. Waksman, Major domain swiveling revealed by the crystal structures of complexes of *E. coli* Rep helicase bound to single-stranded DNA and ADP. *Cell* 90, 635-647 (1997).
22. J. Y. Lee, W. Yang, UvrD helicase unwinds DNA one base pair at a time by a two-part power stroke. *Cell* 127, 1349-1360 (2006).
23. H. Jia et al., Rotations of the 2B sub-domain of *E. coli* UvrD helicase/translocase coupled to nucleotide and DNA binding. *Journal of molecular biology* 411, 633-648 (2011).
24. K. M. Brendza et al., Autoinhibition of *Escherichia coli* Rep monomer helicase activity by its 2B subdomain. *Proceedings of the National Academy of Sciences of the United States of America* 102, 10076-10081 (2005).
25. W. Cheng et al., The 2B domain of the *Escherichia coli* Rep protein is not required for DNA helicase activity. *Proceedings of the National Academy of Sciences of the United States of America* 99, 16006-16011 (2002).
26. S. Myong, I. Rasnik, C. Joo, T. M. Lohman, T. Ha, Repetitive shuttling of a motor protein on DNA. *Nature* 437, 1321-1325 (2005).
27. G. Lee, M. A. Bratkowski, F. Ding, A. Ke, T. Ha, Elastic Coupling Between RNA Degradation and Unwinding by an Exoribonuclease. *Science (New York, N.Y.* 336, 1726-1729 (2012).
28. M. C. Murphy, I. Rasnik, W. Cheng, T. M. Lohman, T. Ha, Probing single-stranded DNA conformational flexibility using fluorescence spectroscopy. *Biophysical journal* 86, 2530-2537 (2004).
29. J. A. Ali, T. M. Lohman, Kinetic measurement of the step size of DNA unwinding by *Escherichia coli* UvrD helicase. *Science (New York, N.Y.* 275, 377-380 (1997).
30. J. R. Moffitt et al., Intersubunit coordination in a homomeric ring ATPase. *Nature* 457, 446-450 (2009).
31. L. R. Brewer, P. R. Bianco, Laminar flow cells for single-molecule studies of DNA-protein interactions. *Nature methods* 5, 517-525 (2008).
32. T. T. Perkins, H. W. Li, R. V. Dalal, J. Gelles, S. M. Block, Forward and reverse motion of single RecBCD molecules on DNA. *Biophysical journal* 86, 1640-1648 (2004).
33. J. G. Yodh, M. Schlierf, T. Ha, Insight into helicase mechanism and function revealed through single-molecule approaches. *Quarterly reviews of biophysics* 43, 185-217 (2010).
34. W. Zhang et al., Directional loading and stimulation of PcrA helicase by the replication initiator protein RepD. *Journal of molecular biology* 371, 336-348 (2007).
35. C. Machon et al., RepD-mediated recruitment of PcrA helicase at the *Staphylococcus aureus* pC221 plasmid replication origin, oriD. *Nucleic acids research* 38, 1874-1888 (2010).
36. J. Park et al., PcrA helicase dismantles RecA filaments by reeling in DNA in uniform steps. *Cell* 142, 544-555 (2010).
37. M. J. Comstock, H. Jia, T. M. Lohman, T. Ha, Y. R. Chemla. (2014).
38. M. N. Dessinges, T. Lionnet, X. G. Xi, D. Bensimon, V. Croquette, Single-molecule assay reveals strand switching and enhanced processivity of UvrD. *Proceedings of the National Academy of Sciences of the United States of America* 101, 6439-6444 (2004).
39. J. G. Yodh, B. C. Stevens, R. Kanagaraj, P. Janscak, T. Ha, BLM helicase measures DNA unwound before switching strands and hRPA promotes unwinding reinitiation. *The EMBO journal* 28, 405-416 (2009).
40. B. X. Huang, H. Y. Kim, Interdomain conformational changes in Akt activation revealed by chemical cross-linking and tandem mass spectrometry. *Mol Cell Proteomics* 5, 1045-1053 (2006).
41. D. Branton et al., The potential and challenges of nanopore sequencing. *Nature biotechnology* 26, 1146-1153 (2008).
42. A. H. Laszlo et al., Decoding long nanopore sequencing reads of natural DNA. *Nature biotechnology*, (2014).
43. M. Vincent, Y. Xu, H. Kong, Helicase-dependent isothermal DNA amplification. *EMBO reports* 5, 795-800 (2004).
44. I. L. Urbatsch et al., Cysteines 431 and 1074 are responsible for inhibitory disulfide cross-linking between the two nucleotide-binding sites in human P-glycoprotein. *The Journal of biological chemistry* 276, 26980-26987 (2001).
45. I. Rasnik, S. Myong, W. Cheng, T. M. Lohman, T. Ha, DNA-binding orientation and domain conformation of the *E. coli* rep helicase monomer bound to a partial duplex junction: single-molecule studies of fluorescently labeled enzymes. *Journal of molecular biology* 336, 395-408 (2004).
46. R. Roy, S. Hohng, T. Ha, A practical guide to single-molecule FRET. *Nat Methods* 5, 507-516 (2008).
47. C. Joo, T. Ha, in *Cold Spring Harb Protoc.* (2012), vol. 2012.
48. Y. Harada, K. Sakurada, T. Aoki, D. D. Thomas, T. Yanagida, Mechanochemical coupling in actomyosin energy transduction studied by in vitro movement assay. *Journal of molecular biology* 216, 49-68 (1990).
49. T. Yanagida, M. Nakase, K. Nishiyama, F. Oosawa, Direct observation of motion of single F-actin filaments in the presence of myosin. *Nature* 307, 58-60 (1984).
50. I. Rasnik, S. A. McKinney, T. Ha, Nonblinking and long-lasting single-molecule fluorescence imaging. *Nat Methods* 3, 891-893 (2006).

51. C. J. CLOPPER, E. S. PEARSON, THE USE OF CONFIDENCE OR FIDUCIAL LIMITS ILLUSTRATED IN THE CASE OF THE BINOMIAL. *Biometrika* 26, 404-413 (1934).
52. J. Gal, R. Schnell, S. Szekeres, M. Kalman, Directional cloning of native PCR products with preformed sticky ends (autosticky PCR). *Molecular & general genetics: MGG* 260, 569-573 (1999).
53. Z. Qi, R. A. Pugh, M. Spies, Y. R. Chemla, Sequence-dependent base pair stepping dynamics in XPD helicase unwinding. *Elife (Cambridge)* 2, e00334 (2013).
54. M. P. Landry, P. M. McCall, Z. Qi, Y. R. Chemla, Characterization of photoactivated singlet oxygen damage in single-molecule optical trap experiments. *Biophysical journal* 97, 2128-2136 (2009).
55. C. Bustamante, Y. R. Chemla, J. R. Moffitt, *High-resolution dual-trap optical tweezers with differential detection*. Single-molecule techniques: a laboratory manual (Cold Spring Harbor Laboratory Press, Cold Spring Harbor, N.Y., 2008).
56. K. Berg-Sørensen, H. Flyvbjerg, Power spectrum analysis for optical tweezers. *Review of Scientific Instruments* 75, 594-612 (2004).

All patents, patent applications, patent application publications and other publications that are cited herein are hereby incorporated by reference as if set forth in their entirety.

It should be understood that the methods, procedures, operations, composition, and systems illustrated in figures may be modified without departing from the spirit of the present disclosure. For example, these methods, procedures, operations, devices and systems may comprise more or fewer steps or components than appear herein, and these steps or components may be combined with one another, in part or in whole.

Furthermore, the present disclosure is not to be limited in terms of the particular embodiments described in this application, which are intended as illustrations of various embodiments. Many modifications and variations can be made without departing from its scope and spirit. Functionally equivalent methods and apparatuses within the scope of the disclosure, in addition to those enumerated herein, will be apparent to those skilled in the art based on the foregoing descriptions.

SEQUENCE LISTING (305 sequences)

SEQ ID NO: 1 - protein, 673 aa, Artificial Sequence
  Description of Artificial Sequence: Synthetic polypeptide
MRLNPGQQQAVEFVTGPLLVLAGAGSGKTRVITNKIAHLIRGSGYQARHIAAVTFTNKAAREMKERVGQTLGRKEARGLMISTFHTLGLDIIKREYAALGMKANFSLFDDTDQLALLKELTEGLIEDDKVLLQQLISTISNWKNDLKTPSQAAASAIGERDRIFAHVYGLYDAHLKACNVLDFDDLILLPTLLLQRNEEVRKRWQNKIRYLLVDEYQDTNTSQYELVKLLVGSRARFTVVGDDDQSIYSWRGARPQNLVLLSQDFPALKVIKLEQNYRSSGRILKAANILIANNPHVFEKRLFSELGYGAELKVLSANNEEHEAERVTGELIAHHFVNKTQYKDYAILYRGNHQSRVFEKFLMQNRIPYKISGGTSFFSRPEIKDLLAYLRVLTNPDDDCAFLRIVNTPKREIGPATLKKLGEWAMTRNKSMFTASFDMGLSQTLSGRGYEALTRFTHWLAEIQRLAEREPIAAVRDLIHGMDYESWLYETSPSPKAAEMRMKNVNQLFSWMTEMLEGSELDEPMTLTQVVTRFTLRDMMERGESEEELDQVQLMTLHASKGLEFPYVYMVGMEEGFLPHQSSIDEDNIDEERRLAYVGITRAQKELTFTLAKERRQYGELVRPEPSRFLLELPQDDLIWEQERKVVSAEERMQKGQSHLANLKAMMAAKRGK

SEQ ID NO: 2 - DNA, 2022 bp, Artificial Sequence
  Description of Artificial Sequence: Synthetic polynucleotide
atgcgtctaaaccccggccaacaacaagctgtcgaattcgttaccggccccttgctggtgctggcgggcgcgggttccggtaaaactcgtgttatcaccaataaaatcgcccatctgatccgcggtagcgggtaccaggcgcggcacattgcggcggtgacctttactaataaagcagcgcgcgagatgaaagagcgtgtagggcagacgctggggcgcaaagaggcgcgtgggctgatgatctccactttccatacgttggggctggatatcatcaaacgcgagtatgcggcgcttgggatgaaagcgaacttctcgttgtttgacgataccgatcagcttgctttgcttaaagagttgaccgaggggctgattgaagatgacaaagttctcctgcaacaactgatttcgaccatctctaactggaagaatgatctcaaaacaccgtcccaggcggcagcaagtgcgattggcgagcgggaccgtatttttgcccatgtttatgggctgtatgatgcacacctgaaagcctgtaacgttctcgacttcgatgatctgattttattgccgacgttgctgctgcaacgcaatgaagaagtccgcaagcgctggcagaacaaaattcgctatctgctggtggatgagtatcaggacaccaacaccagccagtatgagctggtgaaactgctggtgggcagccgcgcgcgctttaccgtggtgggtgacgatgaccagtcgatctactcctggcgcggtgcacgtccgcaaaacctggtgctgctgagtcaggattttccggcgctgaaggtgattaagcttgagcagaactatcgctcttccgggcgtattctgaaagcggcgaacatcctgatcgccaataacccgcacgtctttgaaaagcgtctgttctccgaactgggttatggcgcggagctaaaagtattaagcgcgaataacgaagaacatgaggctgagcgcgttactggcgagctgatcgcccatcacttcgtcaataaaacgcagtacaaagattacgccattctttatcgcggtaaccatcagtcgcgggtgtttgaaaaattcctgatgcaaaaccgcatcccgtacaaaatatctggtggtacgtcgtttttctctcgtcctgaaatcaaggacttgctggcttatctgcgcgtgctgactaacccggacgatgactgcgcatttctgcgtatcgttaacacgccgaagcgagagattggcccggctacgctgaaaaagctgggtgagtgggcgatgacgcgcaataaaagcatgtttaccgccagctttgatatgggcctgagtcagacgcttagcggacgtggttatgaagcattgacccgcttcactcactggttggcagaaatccagcgtctggcggagcgggagccgattgccgcggtgcgtgatctgatccatggcatggattatgaatcctggctgtacgaaacatcgcccagcccgaaagccgccgaaatgcgcatgaagaacgtcaaccaactgtttagctggatgacggagatgctggaaggcagtgaactggatgagccgatgacgctcacccaggtggtgacgcgctttactttgcgcgacatgatggagcgtggtgagagtgaagaagagctggatcaggtgcaactgatgactctccacgcgtcgaaagggctggagtttccttatgtctacatggtcggtatggaagaagggtttttgccgcaccagagcagcatcgatgaagataatatcgatgaggagcggcggctggcctatgtcggcattacccgcgcccagaaggaattgacctttacgctggctaaagaacgccgtcagtacggcgaactggtgcgcccggagccgagccgctttttgctggagctgccgcaggatgatctgatttgggaacaggagcgcaaagtggtcagcgccgaagaacggatgcagaaagggcaaagccatctggcgaatctgaaagcgatgatggcggcaaaacgagggaaataa

SEQ ID NO: 3 - RNA, 2022 nt, Artificial Sequence
  Description of Artificial Sequence: Synthetic polynucleotide
augcgucuaaaccccggccaacaacaagcugucgaauucguuaccggccccuugcuggugcuggcgggcgcggguuccgguaaaacucguguuaucaccaauaaaaucgcccaucugauccgcgguagcggguaccaggcgcggcacauugcggcggugaccuuuacuaauaaagcagcgcgcgagaugaaagagcguguagggcagacgcuggggcgcaaagaggcgcgugggcugaugaucuccacuuuccauacguuggggcuggauaucaucaaacgcgaguaugcggcgcuugggaugaaagcgaacuucucguuguuugacgauaccgaucagcuugcuuugcuuaaagaguugaccgaggggcugauugaagaugacaaaguucuccugcaacaacugauuucgaccaucucuaacuggaagaaugaucucaaaacaccgucccaggcggcagcaagugcgauuggcgagcgggaccguauuuuugcccauguuuaugggcuguaugaugcacaccugaaagccuguaacguucucgacuucgaugaucugauuuuauugccgacguugcugcugcaacgcaaugaagaaguccgcaagcgcuggcagaacaaaauucgcuaucugcugguggaugaguaucaggacaccaacaccagccaguaugagcuggugaaacugcuggugggcagccgcgcgcgcuuuaccguggugggugacgaugaccagucgaucuacuccuggcgcggugcacguccgcaaaaccuggugcugcugagucaggauuuuccggcgcugaaggugauuaagcuugagcagaacuaucgcucuuccgggcguauucugaaagcggcgaacauccugaucgccaauaacccgcacgucuuugaaaagcgucuguucuccgaacuggguuauggcgcggagcuaaaaguauuaagcgcgaauaacgaagaacaugaggcugagcgcguuacuggcgagcugaucgcccaucacuucgucaauaaaacgcaguacaaagauuacgccauucuuuaucgcgguaaccaucagucgcggguguuugaaaaauuccugaugcaaaaccgcaucccguacaaaauaucuggugguacgucguuuuucucucguccugaaaucaaggacuugcuggcuuaucugcgcgugcugacuaacccggacgaugacugcgcauuucugcguaucguuaacacgccgaagcgagagauuggcccggcuacgcugaaaaagcugggugagugggcgaugacgcgcaauaaaagcauguuuaccgccagcuuugauaugggccugagucagacgcuuagcggacgugguuaugaagcauugacccgcuucacucacugguuggcagaaauccagcgucuggcggagcgggagccgauugccgcggugcgugaucugauccauggcauggauuaugaauccuggcuguacgaaacaucgcccagcccgaaagccgccgaaaugcgcaugaagaacgucaaccaacuguuuagcuggaugacggagaugcuggaaggcagugaacuggaugagccgaugacgcucacccagguggugacgcgcuuuacuuugcgcgacaugauggagcguggugagagugaagaagagcuggaucaggugcaacugaugacucuccacgcgucgaaagggcuggaguuuccuuaugucuacauggucgguauggaagaaggguuuuugccgcaccagagcagcaucgaugaagauaauaucgaugaggagcggcggcuggccuaugucggcauuacccgcgcccagaaggaauugaccuuuacgcuggcuaaagaacgccgucaguacggcgaacuggugcgcccggagccgagccgcuuuuugcuggagcugccgcaggaugaucugauuugggaacaggagcgcaaaguggucagcgccgaagaacggaugcagaaagggcaaagccaucuggcgaaucugaaagcgaugauggcggcaaaacgagggaaauaa

SEQ ID NO: 4 - protein, 673 aa, Artificial Sequence; identical to SEQ ID NO: 1
  Description of Artificial Sequence: Synthetic polypeptide
  See specification as filed for detailed description of substitutions and preferred embodiments

SEQ ID NO: 5 - protein, 673 aa, Artificial Sequence; identical to SEQ ID NO: 1
  Description of Artificial Sequence: Synthetic polypeptide

SEQ ID NO: 6 - DNA, 2022 bp, Artificial Sequence; identical to SEQ ID NO: 2
  Description of Artificial Sequence: Synthetic polynucleotide

SEQ ID NO: 7 - RNA, 2022 nt, Artificial Sequence; identical to SEQ ID NO: 3
  Description of Artificial Sequence: Synthetic polynucleotide

SEQ ID NO: 8 - protein, 673 aa, Artificial Sequence; identical to SEQ ID NO: 1
  Description of Artificial Sequence: Synthetic polypeptide
  See specification as filed for detailed description of substitutions and preferred embodiments

SEQ ID NO: 9 - protein, 724 aa, Artificial Sequence
  Description of Artificial Sequence: Synthetic polypeptide
MNFLSEQLLAHLNKEQQEAVRTTEGPLLIMAGAGSGKTRVLTHRIAYLMAEKHVAPWNILAITFTNKAAREMRERVQSLLGGAAEDVWISTFHSMAVRILRRDIDRIGINRNFSILDPTDQLSVMKTILKEKNIDPKKFEPRTILGTISAAKNELLPPEQFAKRASTYYEKVVSDVYQEYQQRLLRCHSLDFDDLIMTTIQLFDRVPDVLHYYQYKFQYIHIDEYQDTNRAQYTLVKKLAERFQNIAAVGDADQSIYRWRGADIQNILSFERDYPNAKVILLEQNYRSTKRILQAANEVIEHNVNRKPKRLWTENPEGKPILYYEAMNEADEAQFVAGRIREAVERGERRYRDFAVLYRTNAQSRVMEEMLLKANIPYQIVGGVKFYDRKEIKDILAYLRVIANPDDDCSLLRIINVPKRGIGASTIDKLVRYAADHELSLFEALGELEMIGLGAKAAGALAAFRSQLEQWTQLQEYVSVTELVEEVLDKSGYREMLKAERTIEAQSRLENLDEFLSVTKHFENVSDDKSLIAFLTDLALISDLDELNGTEQAAEGDAVMLMTLHAAKGLEFPVVFLIGMEEGIFPHNRSLEDDDEMEEERRLAYVGITRAEEELVLTSAQMRTLFGNIQMNPPSRFLNEIPAHLLETASRRQAGASRPAVSRPQASGAVGSWKVGDRANHRKWGIGTVVSVRGGGDDQELDIAFPSPIGIKRLLAKFAPIEKV

SEQ ID NO: 10 - DNA, 2175 bp, Artificial Sequence
  Description of Artificial Sequence: Synthetic polynucleotide
atgaactttttatcggaacagctgctcgcccatttaaacaaagagcaacaagaagccgtcaggacgacggaaggcccgctgctcattatggcgggggcgggaagcgggaaaacgcgggtgttgacgcaccgcatcgcctatttgatggcggaaaagcatgtggcgccgtggaacattttggccattacgtttacgaacaaggcggcgcgcgaaatgcgggaacgtgtgcagtcgctcttaggtggggcggcggaagacgtctggatttcgacgttccactcgatggccgtccgcattttgcgccgcgacattgaccgcatcggcatcaaccgcaatttttccatccttgatccgacggaccagctttcagtcatgaaaacgattttaaaagaaaaaaacatagacccgaaaaaatttgagccgcggacgattttaggcacgatcagcgcggcgaaaaacgagctgttgcctccggagcaattcgcgaagcgggcctcgacgtattacgaaaaagtcgtcagcgatgtgtatcaagaataccaacagcgcctgcttcgctgtcattcgctcgattttgacgatttgatcatgacgacgatccaactgtttgaccgcgtgccggatgtgcttcactattaccaatataagtttcagtacattcatattgatgagtaccaggatacgaaccgcgctcaatatacgctggtcaaaaagctggcggaacgctttcaaaacattgccgccgtcggcgacgccgaccaatcgatttatcggtggcgcggggcggacatccaaaacattttgtcgttcgagcgcgactatccgaacgcaaaagtcattttgcttgaacaaaactaccgctcgacgaagcgcattttgcaagcggcgaacgaagtcatcgagcataacgtcaaccggaagccgaaacggctttggacggaaaacccggaaggaaagccgattctttattatgaggcgatgaacgaagcggacgaagcgcagtttgtcgctggacgcatccgcgaggcggtggagcgcggcgaacgccgctaccgtgattttgctgtcttgtaccggacgaacgcccagtcgcgtgtcatggaggaaatgttgctgaaagcgaacattccgtatcaaattgtcggcggcgtaaagttctatgaccggaaagaaattaaagacattctcgcctatttgcgcgtcattgccaatccggacgatgattgcagcttgcttcgcatcattaacgtgccaaaacgcggcattggcgcctcgacgatcgacaaactcgtccgctatgcagccgatcatgagctgtccttgtttgaggcgctcggcgagctagagatgatcgggcttggcgccaaagcggccggggcgctcgccgcgttccgcagccagctcgagcaatggacacagctgcaagaatacgtctccgtcaccgaactcgtcgaagaagtgctcgacaaatcgggctaccgcgagatgctcaaggcggagcggacgattgaagcacaaagccggctcgagaacttggatgagtttttgtcggtgacgaagcattttgaaaatgtgagcgacgataaatcgctcatcgcctttttaaccgacttggcgctcatttccgatttggacgagctgaacgggacggaacaggccgctgaaggagatgccgtcatgttgatgacgttgcatgccgccaaagggctcgagtttccggtcgtctttttgatcggcatggaagaaggcattttcccgcacaaccgctctctcgaggatgacgatgagatggaagaagaacggcggctggcgtacgtcggcatcacccgcgcggaggaagaacttgtgctgacgagcgcgcaaatgcggacgttgtttggcaacatccaaatgaacccgccgtcgcgctttttgaatgaaattccggcgcatttgcttgagacagcctcgcgccgccaagcgggcgcctcccgcccggccgtttcgcgcccgcaggcaagcggcgccgtgggatcgtggaaagtcggcgatcgggcgaatcaccggaaatggggcatcggcaccgtcgtcagcgtccgcggcggcggcgacgaccaagagctcgacatcgccttcccgagcccgatcggcattaaacggttgcttgccaaatttgcgccgattgagaaagtgtag

SEQ ID NO: 11 - RNA, 2175 nt, Artificial Sequence
  Description of Artificial Sequence: Synthetic polynucleotide
augaacuuuuuaucggaacagcugcucgcccauuuaaacaaagagcaacaagaagccgucaggacgacggaaggcccgcugcucauuauggcgggggcgggaagcgggaaaacgcggguguugacgcaccgcaucgccuauuugauggcggaaaagcauguggcgccguggaacauuuuggccauuacguuuacgaacaaggcggcgcgcgaaaugcgggaacgugugcagucgcucuuagguggggcggcggaagacgucuggauuucgacguuccacucgauggccguccgcauuuugcgccgcgacauugaccgcaucggcaucaaccgcaauuuuuccauccuugauccgacggaccagcuuucagucaugaaaacgauuuuaaaagaaaaaaacauagacccgaaaaaauuugagccgcggacgauuuuaggcacgaucagcgcggcgaaaaacgagcuguugccuccggagcaauucgcgaagcgggccucgacguauuacgaaaaagucgucagcgauguguaucaagaauaccaacagcgccugcuucgcugucauucgcucgauuuugacgauuugaucaugacgacgauccaacuguuugaccgcgugccggaugugcuucacuauuaccaauauaaguuucaguacauucauauugaugaguaccaggauacgaaccgcgcucaauauacgcuggucaaaaagcuggcggaacgcuuucaaaacauugccgccgucggcgacgccgaccaaucgauuuaucgguggcgcggggcggacauccaaaacauuuugucguucgagcgcgacuauccgaacgcaaaagucauuuugcuugaacaaaacuaccgcucgacgaagcgcauuuugcaagcggcgaacgaagucaucgagcauaacgucaaccggaagccgaaacggcuuuggacggaaaacccggaaggaaagccgauucuuuauuaugaggcgaugaacgaagcggacgaagcgcaguuugucgcuggacgcauccgcgaggcgguggagcgcggcgaacgccgcuaccgugauuuugcugucuuguaccggacgaacgcccagucgcgugucauggaggaaauguugcugaaagcgaacauuccguaucaaauugucggcggcguaaaguucuaugaccggaaagaaauuaaagacauucucgccuauuugcgcgucauugccaauccggacgaugauugcagcuugcuucgcaucauuaacgugccaaaacgcggcauuggcgccucgacgaucgacaaacucguccgcuaugcagccgaucaugagcuguccuuguuugaggcgcucggcgagcuagagaugaucgggcuuggcgccaaagcggccggggcgcucgccgcguuccgcagccagcucgagcaauggacacagcugcaagaauacgucuccgucaccgaacucgucgaagaagugcucgacaaaucgggcuaccgcgagaugcucaaggcggagcggacgauugaagcacaaagccggcucgagaacuuggaugaguuuuugucggugacgaagcauuuugaaaaugugagcgacgauaaaucgcucaucgccuuuuuaaccgacuuggcgcucauuuccgauuuggacgagcugaacgggacggaacaggccgcugaaggagaugccgucauguugaugacguugcaugccgccaaagggcucgaguuuccggucgucuuuuugaucggcauggaagaaggcauuuucccgcacaaccgcucucucgaggaugacgaugagauggaagaagaacggcggcuggcguacgucggcaucacccgcgcggaggaagaacuugugcugacgagcgcgcaaaugcggacguuguuuggcaacauccaaaugaacccgccgucgcgcuuuuugaaugaaauuccggcgcauuugcuugagacagccucgcgccgccaagcgggcgccucccgcccggccguuucgcgcccgcaggcaagcggcgccgugggaucguggaaagucggcgaucgggcgaaucaccggaaauggggcaucggcaccgucgucagcguccgcggcggcggcgacgaccaagagcucgacaucgccuucccgagcccgaucggcauuaaacgguugcuugccaaauuugcgccgauugagaaaguguag

SEQ ID NO: 12 - protein, 724 aa, Artificial Sequence; identical to SEQ ID NO: 9
  Description of Artificial Sequence: Synthetic polypeptide
  See specification as filed for detailed description of substitutions and preferred embodiments

SEQ ID NO: 13 - protein, 25 aa, Artificial Sequence
  Description of Artificial Sequence: Synthetic peptide
FHTLGLDIIKREYAALGMKANFSLF

SEQ ID NO: 14 - protein, 19 aa, Artificial Sequence
  Description of Artificial Sequence: Synthetic peptide
GLYDAHLKACNVLDFDDLI

SEQ ID NO: 15 - protein, 15 aa, Artificial Sequence
  Description of Artificial Sequence: Synthetic peptide
AYLRVLTNPDDDSAF

SEQ ID NO: 16 - protein, 14 aa, Artificial Sequence
  Description of Artificial Sequence: Synthetic peptide
GEWAMTRNKSMFTA

SEQ ID NO: 17 - DNA, 30 bp, Artificial Sequence
  Description of Artificial Sequence: Synthetic oligonucleotide
tttttttttttttttttttttttttttttt

SEQ ID NO: 18 - protein, 4 aa, Unknown
  Description of Unknown: "DEAD-box" RNA helicase peptide
DEAD

SEQ ID NO: 19 - protein, 23 aa, Artificial Sequence
  Description of Artificial Sequence: Synthetic peptide
AREMKERVGQTLGRKEARGLMIS

SEQ ID NO: 20 - protein, 12 aa, Artificial Sequence
  Description of Artificial Sequence: Synthetic peptide
GQTLGRKEARGL

SEQ ID NO: 21 - protein, 28 aa, Artificial Sequence
  Description of Artificial Sequence: Synthetic peptide
FSWMTEMLEGSELDEPMTLTQVVTRFTL

SEQ ID NO: 22 - protein, 7 aa, Artificial Sequence
  Description of Artificial Sequence: Synthetic peptide
SELDEPM

SEQ ID NO: 23 - protein, 21 aa, Artificial Sequence
  Description of Artificial Sequence: Synthetic peptide
AREMRERVQSLLGGAAEDVWI

SEQ ID NO: 24 - protein, 11 aa, Artificial Sequence
  Description of Artificial Sequence: Synthetic peptide
QSLLGGAAEDV

SEQ ID NO: 25 - protein, 19 aa, Artificial Sequence
  Description of Artificial Sequence: Synthetic peptide
LSVTKHFENVSDDKSLIAF

SEQ ID NO: 26 - protein, 7 aa, Artificial Sequence
  Description of Artificial Sequence: Synthetic peptide
SDDKSLI

SEQ ID NO: 27 - protein, 21 aa, Artificial Sequence
  Description of Artificial Sequence: Synthetic peptide
AAEMRHRIGQLMGTSQGGMWV

SEQ ID NO: 28 - protein, 11 aa, Artificial Sequence
  Description of Artificial Sequence: Synthetic peptide
GQLMGTSQGGM

SEQ ID NO: 29 - protein, 19 aa, Artificial Sequence
  Description of Artificial Sequence: Synthetic peptide
VTATRQFSYNEEDEDLMPL

SEQ ID NO: 30 - protein, 7 aa, Artificial Sequence
  Description of Artificial Sequence: Synthetic peptide
EEDEDLM

SEQ ID NO: 31 - DNA, 2022 bp, Escherichia coli
atgcgtctaaaccccggccaacaacaagctgtcgaattcgttaccggcccctgcctggtgctggcgggcgcgggttccggtaaaactcgtgttatcaccaataaaatcgcccatctgatccgcggttgcggttatcaggcgcggcacattgcggcggtgacctttactaataaagcagcgcgcgagatgaaagagcgtgtagggcagacgctggggcgcaaagaggcgcgtgggctgatgatctccactttccatacgttggggctggatatcatcaaacgcgagtatgcggcgcttgggatgaaagcgaacttctcgttgtttgacgataccgatcagcttgctttgcttaaagagttgaccgaggggctgattgaagatgacaaagttctcctgcaacaactgatttcgaccatctctaactggaagaatgatctcaaaacaccgtcccaggcggcagcaagtgcgattggcgagcgggaccgtatttttgcccattgttatgggctgtatgatgcacacctgaaagcctgtaacgttctcgacttcgatgatctgattttattgccgacgttgctgctgcaacgcaatgaagaagtccgcaagcgctggcagaacaaaattcgctatctgctggtggatgagtatcaggacaccaacaccagccagtatgagctggtgaaactgctggtgggcagccgcgcgcgctttaccgtggtgggtgacgatgaccagtcgatctactcctggcgcggtgcacgtccgcaaaacctggtgctgctgagtcaggattttccggcgctgaaggtgattaagcttgagcagaactatcgctcttccgggcgtattctgaaagcggcgaacatcctgatcgccaataacccgcacgtctttgaaaagcgtctgttctccgaactgggttatggcgcggagctaaaagtattaagcgcgaataacgaagaacatgaggctgagcgcgttactggcgagctgatcgcccatcacttcgtcaataaaacgcagtacaaagattacgccattctttatcgcggtaaccatcagtcgcgggtgtttgaaaaattcctgatgcaaaaccgcatcccgtacaaaatatctggtggtacgtcgtttttctctcgtcctgaaatcaaggacttgctggcttatctgcgcgtgctgactaacccggacgatgacagcgcatttctgcgtatcgttaacacgccgaagcgagagattggcccggctacgctgaaaaagctgggtgagtgggcgatgacgcgcaataaaagcatgtttaccgccagctttgatatgggcctgagtcagacgcttagcggacgtggttatgaagcattgacccgcttcactcactggttggcagaaatccagcgtctggcggagcgggagccgattgccgcggtgcgtgatctgatccatggcatggattatgaatcctggctgtacgaaacatcgcccagcccgaaagccgccgaaatgcgcatgaagaacgtcaaccaactgtttagctggatgacggagatgctggaaggcagtgaactggatgagccgatgacgctcacccaggtggtgacgcgctttactttgcgcgacatgatggagcgtggtgagagtgaagaagagctggatcaggtgcaactgatgactctccacgcgtcgaaagggctggagtttccttatgtctacatggtcggtatggaagaagggtttttgccgcaccagagcagcatcgatgaagataatatcgatgaggagcggcggctggcctatgtcggcattacccgcgcccagaaggaattgacctttacgctgtgtaaagaacgccgtcagtacggcgaactggtgcgcccggagccgagccgctttttgctggagctgccgcaggatgatctgatttgggaacaggagcgcaaagtggtcagcgccgaagaacggatgcagaaagggcaaagccatctggcgaatctgaaagcgatgatggcggcaaaacgagggaaataa

SEQ ID NO: 32 - protein, 673 aa, Escherichia coli
MRLNPGQQQAVEFVTGPCLVLAGAGSGKTRVITNKIAHLIRGCGYQARHIAAVTFTNKAAREMKERVGQTLGRKEARGLMISTFHTLGLDIIKREYAALGMKANFSLFDDTDQLALLKELTEGLIEDDKVLLQQLISTISNWKNDLKTPSQAAASAIGERDRIFAHCYGLYDAHLKACNVLDFDDLILLPTLLLQRNEEVRKRWQNKIRYLLVDEYQDTNTSQYELVKLLVGSRARFTVVGDDDQSIYSWRGARPQNLVLLSQDFPALKVIKLEQNYRSSGRILKAANILIANNPHVFEKRLFSELGYGAELKVLSANNEEHEAERVTGELIAHHFVNKTQYKDYAILYRGNHQSRVFEKFLMQNRIPYKISGGTSFFSRPEIKDLLAYLRVLTNPDDDSAFLRIVNTPKREIGPATLKKLGEWAMTRNKSMFTASFDMGLSQTLSGRGYEALTRFTHWLAEIQRLAEREPIAAVRDLIHGMDYESWLYETSPSPKAAEMRMKNVNQLFSWMTEMLEGSELDEPMTLTQVVTRFTLRDMMERGESEEELDQVQLMTLHASKGLEFPYVYMVGMEEGFLPHQSSIDEDNIDEERRLAYVGITRAQKELTFTLCKERRQYGELVRPEPSRFLLELPQDDLIWEQERKVVSAEERMQKGQSHLANLKAMMAAKRGK

SEQ ID NO: 33 - DNA, 10 bp, Artificial Sequence
  Description of Artificial Sequence: Synthetic oligonucleotide
tttttttttt

SEQ ID NO: 34 - DNA, 15 bp, Artificial Sequence
  Description of Artificial Sequence: Synthetic oligonucleotide
ttttttttttttttt

SEQ ID NO: 35 - DNA, 75 bp, Artificial Sequence
  Description of Artificial Sequence: Synthetic oligonucleotide
ttttttttttttttttttttttttttttttttttttttttttttttttttttttttttttttttttttttttttt

SEQ ID NO: 36 - protein, 6 aa, Artificial Sequence
  Description of Artificial Sequence: Synthetic 6xHis tag
HHHHHH

SEQ ID NO: 37 - DNA, 20 bp, Artificial Sequence
  Description of Artificial Sequence: Synthetic oligonucleotide
tttttttttttttttttttt

SEQ ID NO: 38 - DNA, 2175 bp, Geobacillus stearothermophilus
atgaactttttatcggaacagctgctcgcccatttaaacaaagagcaacaagaagccgtcaggacgacggaaggcccgctgctcattatggcgggggcgggaagcgggaaaacgcgggtgttgacgcaccgcatcgcctatttgatggcggaaaagcatgtggcgccgtggaacattttggccattacgtttacgaacaaggcggcgcgcgaaatgcgggaacgtgtgcagtcgctcttaggtggggcggcggaagacgtctggatttcgacgttccactcgatgtgcgtccgcattttgcgccgcgacattgaccgcatcggcatcaaccgcaatttttccatccttgatccgacggaccagctttcagtcatgaaaacgattttaaaagaaaaaaacatagacccgaaaaaatttgagccgcggacgattttaggcacgatcagcgcggcgaaaaacgagctgttgcctccggagcaattcgcgaagcgggcctcgacgtattacgaaaaagtcgtcagcgatgtgtatcaagaataccaacagcgcctgcttcgcaatcattcgctcgattttgacgatttgatcatgacgacgatccaactgtttgaccgcgtgccggatgtgcttcactattaccaatataagtttcagtacattcatattgatgagtaccaggatacgaaccgcgctcaatatacgctggtcaaaaagctggcggaacgctttcaaaacatttgcgccgtcggcgacgccgaccaatcgatttatcggtggcgcggggcggacatccaaaacattttgtcgttcgagcgcgactatccgaacgcaaaagtcattttgcttgaacaaaactaccgctcgacgaagcgcattttgcaagcggcgaacgaagtcatcgagcataacgtcaaccggaagccgaaacggctttggacggaaaacccggaaggaaagccgattctttattatgaggcgatgaacgaagcggacgaagcgcagtttgtcgctggacgcatccgcgaggcggtggagcgcggcgaacgccgctaccgtgattttgctgtcttgtaccggacgaacgcccagtcgcgtgtcatggaggaaatgttgctgaaagcgaacattccgtatcaaattgtcggcggcttaaagttctatgaccggaaagaaattaaagacattctcgcctatttgcgcgtcattgccaatccggacgatgatttaagcttgcttcgcatcattaacgtgccaaaacgcggcattggcgcctcgacgatcgacaaactcgtccgctatgcagccgatcatgagctgtccttgtttgaggcgctcggcgagctagagatgatcgggcttggcgccaaagcggccggggcgctcgccgcgttccgcagccagctcgagcaatggacacagctgcaagaatacgtctccgtcaccgaactcgtcgaagaagtgctcgacaaatcgggctaccgcgagatgctcaaggcggagcggacgattgaagcacaaagccggctcgagaacttggatgagtttttgtcggtgacgaagcattttgaaaatgtgagcgacgataaatcgctcatcgcctttttaaccgacttggcgctcatttccgatttggacgagctgaacgggacggaacaggccgctgaaggagatgccgtcatgttgatgacgttgcatgccgccaaagggctcgagtttccggtcgtctttttgatcggcatggaagaaggcattttcccgcacaaccgctctctcgaggatgacgatgagatggaagaagaacggcggctggcgtacgtcggcatcacccgcgcggaggaagaacttgtgctgacgagcgcgcaaatgcggacgttgtttggcaacatccaaatgaacccgccgtcgcgctttttgaatgaaattccggcgcatttgcttgagacagcctcgcgccgccaagcgggcgcctcccgcccggccgtttcgcgcccgcaggcaagcggcgccgtgggatcgtggaaagtcggcgatcgggcgaatcaccggaaatggggcatcggcaccgtcgtcagcgtccgcggcggcggcgacgaccaagagctcgacatcgccttcccgagcccgatcggcattaaacggttgcttgccaaatttgcgccgattgagaaagtgtag

SEQ ID NO: 39 - protein, 724 aa, Geobacillus stearothermophilus
MNFLSEQLLAHLNKEQQEAVRTTEGPLLIMAGAGSGKTRVLTHRIAYLMAEKHVAPWNILAITFTNKAAREMRERVQSLLGGAAEDVWISTFHSMCVRILRRDIDRIGINRNFSILDPTDQLSVMKTILKEKNIDPKKFEPRTILGTISAAKNELLPPEQFAKRASTYYEKVVSDVYQEYQQRLLRNHSLDFDDLIMTTIQLFDRVPDVLHYYQYKFQYIHIDEYQDTNRAQYTLVKKLAERFQNICAVGDADQSIYRWRGADIQNILSFERDYPNAKVILLEQNYRSTKRILQAANEVIEHNVNRKPKRLWTENPEGKPILYYEAMNEADEAQFVAGRIREAVERGERRYRDFAVLYRTNAQSRVMEEMLLKANIPYQIVGGLKFYDRKEIKDILAYLRVIANPDDDLSLLRIINVPKRGIGASTIDKLVRYAADHELSLFEALGELEMIGLGAKAAGALAAFRSQLEQWTQLQEYVSVTELVEEVLDKSGYREMLKAERTIEAQSRLENLDEFLSVTKHFENVSDDKSLIAFLTDLALISDLDELNGTEQAAEGDAVMLMTLHAAKGLEFPVVFLIGMEEGIFPHNRSLEDDDEMEEERRLAYVGITRAEEELVLTSAQMRTLFGNIQMNPPSRFLNEIPAHLLETASRRQAGASRPAVSRPQASGAVGSWKVGDRANHRKWGIGTVVSVRGGGDDQELDIAFPSPIGIKRLLAKFAPIEKV

SEQ ID NO: 40 - DNA, 18 bp, Artificial Sequence
  Description of Artificial Sequence: Synthetic oligonucleotide
gcctcgctgccgtcgcca

SEQ ID NO: 41 - DNA, 29 bp, Artificial Sequence
  Description of Artificial Sequence: Synthetic oligonucleotide
tggcgacggcagcgaggcttttttttttt

SEQ ID NO: 42 - DNA, 50 bp, Artificial Sequence
  Description of Artificial Sequence: Synthetic oligonucleotide
tcaactagcagtcataggagaagtattaacatgcctcgctgccgtcgcca

SEQ ID NO: 43 - DNA, 80 bp, Artificial Sequence
  Description of Artificial Sequence: Synthetic oligonucleotide
tggcgacggcagcgaggcatgttaatacttctcctatgactgctagttgatttttttttttttttttttttttttttttt

SEQ ID NO: 44 - protein, 5 aa, Artificial Sequence
  Description of Artificial Sequence: Synthetic penta-His tag
HHHHH

SEQ ID NO: 45 - DNA, 38 bp, Artificial Sequence
  Description of Artificial Sequence: Synthetic oligonucleotide
tggcgacggcagcgaggctttttttttttttttttttt

SEQ ID NO: 46 - DNA, 61 bp, Artificial Sequence
  Description of Artificial Sequence: Synthetic oligonucleotide
ctaatagccggttaagtggtaatttttttaccacccaaagcctgaagagctaatcgttcgg

SEQ ID NO: 47 - DNA, 63 bp, Artificial Sequence
  Description of Artificial Sequence: Synthetic oligonucleotide
ccgaacgattagctcttcaggctttgggtggtaaaaaaattaccacttttttttttttttttt

SEQ ID NO: 48 - DNA, 18 bp, Artificial Sequence
  Description of Artificial Sequence: Synthetic oligonucleotide
ggcagggatattctggca

SEQ ID NO: 49 - DNA, 39 bp, Artificial Sequence
  Description of Artificial Sequence: Synthetic oligonucleotide
  modified_base (15)..(15): Abasic nucleotide
gatcagtggacaganaagcctgaagagctaatcgttcgg

SEQ ID NO: 50 - DNA, 25 bp, Artificial Sequence
  Description of Artificial Sequence: Synthetic oligonucleotide
ttctgtccactgatctttttttttt

SEQ ID NO: 51 - DNA, 30 bp, Artificial Sequence
  Description of Artificial Sequence: Synthetic oligonucleotide
ttctgtccactgatcttttttttttttttt

SEQ ID NO: 52 - DNA, 90 bp, Artificial Sequence
  Description of Artificial Sequence: Synthetic oligonucleotide
ttctgtccactgatcttttttttttttttttttttttttttttttttttttttttttttttttttttttttttttttttttttttttttt

SEQ ID NO: 53 - protein, 749 aa, Leuconostoc citreum
MSVETLTNGMNNKQAEAVQTTEGPLLIMAGAGSGKTRVLTHRIAHLVQDLNVFPWRILAITFTNKAAREMRERIAALLSEDVARDIWVSTFHALAVRILRRDGEAIGLAKNFTIIDTSAQRTLMKRVINDLNLDTNQYDPRTILGMISNAKNDMLRPRDYAKAADNAFQETVAEVYTAYQAELKRSQSVDFDDLIMLTIDLFQSAPEVLARYQQQFEYLHVDEYQDTNDAQYTIVNLLAQRSKNLAVVGDADQSIYGWRGANMNNILNFEKDYPNAHTVMLEQNYRSTQNILDAANAVINHNNERVPKKLWTENGKGDQITYYRAQTEHDEANFILSNIQQLRETKHMAYSDFAVLYRTNAQSRNIEESLVKANMPYSMVGGHKFYERKEILDIMAYMSLITNPDDNAAFERVVNEPKRGLGATSLTRLRELANRLNVSYMKAIESIELAPSITTKAASKFLTFAEMMHNLRQQSEFLNVTELTELVMTQSGYRQMLAEKNDPDSQARLENLEEFLSVTKEFDDKYQPEDPESIDPVTDFLGTTALMSDLDDFEEGDGAVTLMTLHAAKGLEFPVVFLIGLEEGIFPLSRAMMDEDLLEEERRLAYVGITRAMKKLFLTNAFSRLLYGRTQANEPSRFIAEISPELLETAYSGLSRDKTQKKTLPFDRKMQRATATTYQATPVTKITNGVTGGDQTSWSTGDKVSHKKWGVGTVISVSGRADDQELKVAFPSEGVKQLLAAFAPIQKVD

SEQ ID NO: 54 - protein, 696 aa, Coprothermobacter proteolyticus
MALPQENLIPPSPSHNHLTLSLRSHIGGFFIYNEDVDSVDLSKLNEAQKQAVTAPPKPLAIIAGPGSGKTRVLTYRALFAVKEWHLPPERILAITFTNKAADELKERLGRLIPEGDRIFAATMHSFAARMLRYFAPYAGISQNFVIYDDDDSKGLIEDILKQMNMDTKRFRPNDVLNHISAAKARMFDCNTFPEFIRQRYGSWGYYFDTVHQVFMTYERLKEQSQALDFDDLIMVLAQRMEDRPELREMIAGLFDLVMVDEFQDTNFAQYQMLLYMTNPHYSGMNNVTIVGDPDQSIYGFRAAEYYNIKRFIDDYNPEVVFLDLNYRSNRTIVDSASALINDSPSALFERKLESIKGAGNKLILRRPFDDADAAITAAFEVQRLHKMGIPYEEIAVLMRTRALTARVEREFATRNIQYHIIGGVPFFARREIKDILAYLRLSRNAMDRVSLKRILTMKKRGFGTASLEKLFNFAEENKLTLLEAMKAAVESLLFKKLSMNDYLESLYTLIQTIQEIAEPSQAIYLVMEQENLLDHFRSISKSEEEYIERTENVKQLISIAEESADMDDFLQRSALGTRENNGGVEGVAISTVHGVKGLEFQAVILYYVTDGFFPHSLSVTTAEKEEERRLLYVAMTRAKEHLIFYVPYKQPWGNGFEQMARPSPFLRSIPKELWDGKPNEIESLYAPYSPQQKWSE

SEQ ID NO: 55 - protein, 737 aa, Anaerolinea thermophila
MDSLEHLNPQQRAAVTASAGPVLVLAGPGSGKTRVLTFRIGYLLSQLGVAPHHILAVTFTNKAAREMQSRVEKLLGHSLQGMWLGTFHAICARILRREQQYLPLDANFVIFDEDDQQALIKRALRDLNLDEKLYRPTSVHAAISNAKNNLILPEDYPTATYRDEVVARVYKRYQELLVSSNAVDFDDLLLYAWKLLNEFSTVREQYARRFEHILVDEFQDTNLAQYELVKLLASYHRNLFVVGDEDQSIYRWRGADYRNVLRFEEDFPDRQKILLEQNYRSTQRVLDAAQAVINRNRNRTPKRLKSTPEHGEGEKLVLYEAVDDYGEAAFVVDTIQQLVAGGKARPGDFAIMYRTNAQSRLLEEAFLRAGVPYRLVGAMRFYGRREVKDMIAYLRLVQNPADEASLGRVINVPPRGIGDKSQLALQMEAQRTGRSAGLILMELGREGKDSPHWQALGRNASLLADFGSLLGEWHRLKDEISLPSLFQRILNDLAYREYIDDNTEEGQSRWENVQELLRIAYEYEEKGLTAFLENLALVSDQDTLPENVEAPTLLTLHAAKGLEFPIVFITGLDDGLIPHNRSLDDPEAMAEERRLFYVGLTRAKKRVYLVRAAQRSTYGSFQDSIPSRFLKDIPADLIQQDGRGRRMGRSWQSESRRSWDDNYAGTWGSRPERAKPSHAPILQPRFKPGMRVKHPSWGEGLVVDSRIQDEDETVDIFFDSVGFKRVIASIANLEILS

SEQ ID NO: 56 - protein, 708 aa, Thermus scotoductus
MQGPQSSHPGDELLRSLNEAQRQAVLHFEGPALVVAGAGSGKTRTVVHRVAYLIAKRGVFPSEILAVTFTNKAAEEMRERLKRMVKGGGELWVSTFHSAALRILRVYGERVGLKPGFVVYDEDDQTALIKEVLKELGLAARPGPLKALLDRAKNRGEAPESLLSELPDYYAGLSRGRLLDVLKRYEEALKAQGALDFGDILLYALRLLEEDPEVLKRVRRRARFIHVDEYQDTNPVQYRFTKLLAGEEANLMAVGDPDQGIYSFRAADIKNILEFTRDFPGAKVYRLEENYRSTEAILRFANALIVNNALRLEKTLRPVKPGGEPVRLYRARDARDEARFVAEEILRLGPPFDRVAVLYRTNAQSRLLEQTLASRGVPARVVGGVGFFERAEVKDLLAYARLSLNPLDGVSLKRVLNTPPRGIGPATVEKVEALAREKGLPLFEALRVAAEVLPRPAPLRHFLALMEELQELAFGPAEGFFRHLLEATDYPAYLREAYPEDYEDRLENVEELLRAAKEAEGLMEFLDKVALTARAEEPGEPAGKVALMTLHNAKGLEFPVVFVVGVEEGLLPHRSSLSTLEGLEEERRLFYVGVTRAQERLYLSYAEEREVYGRTEATRPSRFLEEVEGGLYEEYDPYRASAKVSPSPAPGEARASKPGAYRGGEKVIHPRFGQGTVVAAMGDEVTVHFEGVGLKRLSLKYADLRPVG

SEQ ID NO: 57 - protein, 621 aa, Thermus scotoductus
MLNPEQEAVANHFTGPALVIAGPGSGKTRTVVHRIARLIRKGVDPETVTAVTFTKKAAGEMRERLVHLVGEETATKVFTATFHSLAYHVLKDTGTVRVLPAEQARKLIGEILEDLQAPKKLTAKVAQGAFSRVKNSGGGRRELIALYTDFSPYIERAWDAYEAYKEEKRLLDFDDLLHQAVHELSTDIDLQARWQHRARFLIVDEYQDTNLVQFNLLRLLLTPEENLMAVGDPNQAIYAWRGADFRLILEFKKHFPNATVYKLHTNYRSHNGIVTAAKKVITHNTQREDLDLKALRNGDLPTLVQAQSREDEALAVAEVVKRHLDQGTPPEEIAILLRSLAYSRPIEATLRRYRIPYTIVGGLSFWNRKEVQLYLHLLQAASGNPESTVEVLASLVPGMGPKKARKALETGKYPKEAEEALQLLQDLRAYTGERGEHLASAVQNTLHRHRKTLWPYLLELADGIEEAAWDRWANLEEAVSTLFAFAHHTPEGDLDTYLADILLQEEDPEDSGDGVKIMTLHASKGLEFAVVLLPFLVEGAFPSWRSAQNPATLEEERRLFYVGLTRAKEHAYLSYHLVGERGATSPSRFARETPANLIHYNPTIGYQGKETDTLSKLAELF

SEQ ID NO: 58 - protein, 591 aa, Thermococcus sp.
MSEALPVTSFEFSLPEESVIKIYGPPGTGKTTTLVRIIEHLIGFHDHTEFLESYGLSLLFGQYGAEDVIFMTFQTSALKEFEARTGIKVKDRQNKPGRYYSTVHGIAFRLLIDSGAIDGVITQNFGSLSPEDWFRLFCRQNGLRFESSEMGYSNVFNDGNRLWNALTWAYNVYYPTKGPKARHEALKRLAPKLWKYPPLWEEYKTEKGILDYNDMLVKAYEGLKSGEIDPRNLPGHKYSPKVLIVDEFQDLSPLQFEIFRLLANYMDLVIIAGDDDQTIFSYQGADPRLMNYVPGREIVLKRSYRLPIVVQAKAMTVISKTRHRKEKTVAPRTDLGDFKYKLFWFPDFLNDLVREAQEGHSIFILVRTNRQVLKLGKELILAGVHFRHLKVDYRSIWEAGSKEWGTFRDLVQALLKARRGEELEIADLVTILYYSELIDWHLGEKLPEKERYKKIAEQMEKTIEAIEKGLMPFDILKVKDDPFSVLDLEKIESLSPRHGKVAVELIREIMKEKSQVVSVPRDAEIYLDTLHASKGREADVVFLINDLPRKWSSILKTREELDAERRVWYVGLTRARKKVYLLNGKHPFPVL

SEQ ID NO: 59 - protein, 547 aa, Thermococcus sp.
MRVKIYGPPGTGKTTTLQRTIDYTLGNSSEPPIPLPESFPTDLEPKNLAFVSFTNTAIDVIGKRTGITTRSKEAPYMRTIHGLILSVLAEHFDPVAVDNLGKLADIQAEFSMRMGYYYSKDPFEFAEGNMKFNVITRALELYLPKTGDVEEALKLIDNREDRKFALAWYRYKRQKKIMDFDDILVIGYEHLEDFYVPVEVAFIDEGQDNGPLDYILLEKGFEGAKFVFLAGDPLQSIYGFKGADPRLFVRWKADKEIILPRSYRLPKKVWLLSQSWALSLGIKGAVVRYAPSEKLGRVSRMKFIEALSYAVEQAKRGRSVLILARTNSLVKFVGNILSIEFGVAYGHLKRASYWESHLLKFIEGLQMLKLWDGVTPIKVQDTKPITGLIRKLKDKHAREVLRRWRDSRQWSLEVQAVLQRIKKNPSEYFYITDFDRQALKAYFSKARLDLTEELIIDTIHAAKGEEADVVIFLDFIPTRSEERINPEELQEKLVAYVGFTRAREELIIVPTPAIKYHPMRDFMGVRQILGVVNFHKHLLIKELVGGL

SEQ ID NO: 60 - protein, 591 aa, Thermococcus sp.
MSEALPVTSFEFSLPRERIIKLYGAPGTGKTTTLVKIIEHLIGFQDHTEFLENYGINLPFGQYEPGEVIFMTFQTSALKEFEARTGIKVKDRQNKPGRYYSTVHGIAFRLLIDSGAVDGLITQNFGSLSPEDWFRNFCRQNGLRFESSEMGYSNVFNEGNQLWNALTWAYNVYYPTKGPKARYEALKRLAPKLWKFPPLWEEYKKGRGILDYNDMLVRAYEGLRSGEIDPRNLPGHKYSPKVLIVDEFQDLSPLQFEIFRLLANHMDLVIIAGDDDQTIFSYQGADPRLMNYVPGLEVVLRKSHRLPIVVQAKALTVISKTRHRKEKTVAPRTDLGDFKYKLFWFPDFLNDLVREAQEGHSIFILVRTNRQVLKLGKELILAGVHFEHLKVDYRSIWEAGSKEWGTFRDLVQALLKAKRGEELEVADLVTILYYSELIDWHLGEGISEKERYKKIAEQMEKTIEAIEKGLMPFDVLRVKENPFSVLDLEKIESLSPRHGKVAVELIKELMKEKSQVVSIPKDARIYLDTLHASKGREADVVFLINDLPRKWSSILKTREELDAERRVWYVGLTRARKKVYLLNGKHPFPVL

SEQ ID NO: 61 - protein, 591 aa, Thermococcus sp.
MSEALSITSFDFTLPRERIIKIYGPPGTGKTTTLVRIIEHLIGFQDHTEFLENYGLSLPFGQYGAEDVIFMTFQTSALKEFEARTGIKVKDRQNKPGRYYSTVHGIAFRLLIDSGAVDGLITQNFGSLSPEDWFRHFCRQNGLRFESSEMGYSNIFNEGNQLWNALTWAYNVYYPTKGPKARYEALKRLAPKLWKFPPLWEEYKKEKGILDYNDMLIRAYEGLKSGEIDPRNLPGHKYSPKVLIVDEFQDLSPLQFEIFRLLANHMDLVIIAGDDDQTIFSYQGADPRLMNYVPGREIVLSKSYRLPIVVQAKALTVISKTRHRKEKTVAPRTDLGDFKYKLFWFPDFLNDLVREAQEGHSIFILVRTNRQVLKLGKELILAGVHFEHLKVDYRSIWEAGSKEWGTFRDLVQALLKAKKGEELEVADLVTILYYSELIDWHLGERISEKERYKKIAEQMEKTIEAIEKGLMPFDILKVKENPFSVLDLEKIESLSPRHGKVAVELIKELMKEKSQVVSIPKDAKIYLDTLHASKGREADVVFLINDLPRKWSNILKTREELDAERRVWYVGLTRARKKVYLLNGKHPFPIL

SEQ ID NO: 62 - protein, 665 aa, Thermococcus nautili
MNENEKLSKFIAKLKVLIEMERKAEIEAMRAEMRRLSGREREKVGRAVLGLNGKVIGEELGYFLVRYGREREIKTEISVGDLVVISKRDPLKSDLVGTVVEKGKRFITVALETVPEWALKSVRIDLYANDITFKRWLENLENLRESGRRALELYLGLREPEGGEEVEFTPFDKSLNASQRRAIAKALGSPDFFLIHGPFGTGKTRTLVELIRQEVARGNRVLATAESNVAVDNLVERLVDSGLKVVRVGHPSRVSRGLHETTLAYLMTQHELYGELRELRVIGENLKEKRDTFTKPAPKYRRGLTDRQILRLAEKGIGTRGVPARLIREMAQWLKINEQVQKTFDDARKLEERIAREIIREADVVLTTNSSAGLEVVDYGSYDVAIIDEATQATIPSVLIPINRAGRFVLAGDHKQLPPTILSEKAKELSKTLFEGLIERYPGKSEMLTVQYRMNERLMEFPSREFYDGRIEADESIRRITLADLGVKSPEDGDAWAEVLKPENVLVFIDTARREDRFERQRYGSESRENPLEARLVKEAVEGLLRLGVKAEWIGVITPYDDQRDLISSLLPEEIEVKTVDGYQGREKEVIVLSFVRSNRKGELGFLKDLRRLNVSLTRAKRKLILIGDSSTLSSHPTYRRLVEFVRERETVVDAKRLIGKVKIK

SEQ ID NO: 63 - protein, 533 aa, Thermococcus onnurineus
MTAPIPTTYSILGVAGAGKTTQLIDLLNYLNFENSRNEKIWERHFEPVELNRIAFISFSNTAIQEIANRTGIEIKARKKSAPGRYFRTVTGLAEVLLYENNLMTFEEVRSVSKLEGFRIKWAREHGMYYKPRDNDISYSGNEFFAEYSRLVNTYYHVKSLSEIIEMHSKSHLLLDYIREKEKLGIVDYEDILMRAYDYRNDIVVDLEYMIIDEAQDNSLLDYATLLPIAKNNATELVLAGDDAQLIYDFRGANYKLFHKLIERSEIILNLTETRRFGSEIANLATAIIDDMNYIQKREVLSAATHSTKVAHIDLFQMMSILQNMATTDLTVYILARTNAVLNYVAKVLDEYKIQYKKNERITDFDRFLLSLNRLMRNEYTNDDIYTIYNYLRNKVAREEELKERLFQHKLHWTEKDVLGILLLAYEQTTAKRILTTAKNTNFKIKLSTIHSAKGSEADVVFLINSVPHKTKMKILENYEGEKRVLYVAVTRARKFLFIVDQPVARRYEQLYYIRSYESRAQGSLVNRVAVPVA

SEQ ID NO: 64 - protein, 661 aa, Thermococcus kodakarensis
MNEKEVLLSKFIAHLKELVEMERRAEIEAMRLEMRRLSGREREKVGRAVLGLNGKVIGEELGYFLVRYGRDREIKTEISVGDLVVISKRDPLKSDLVGTVVEKGKRFLTVAIETVPEWALKGVRIDLYANDITFKRWMENLDNLRESGRKALELYLGLREPEESEPVEFQPFDKSLNASQRGAIAKALGSGDFFLVHGPFGTGKTRTLVELIRQEVARGHKVLATAESNVAVDNIVERLADSGLKVVRIGHPSRVSKALHETTLAYLITQHDLYAELRELRVIGENLKEKRDTFTKPAPKYRRGLSDREILRLAEKGIGTRGVPARLIREMAEWIRINQQVQKTFDDARKLEERIAREIIQEADVVLTTNASAGLEVVDYGEYDVAVIDEATQATIPSVLIPINRAKRFVLAGDHKQLPPTILSEKAKELSKTLFEGLIERYPEKSEMLTVQYRMNERLMEFPSREFYDGKIKAHESVKNITLADLGVSEPEFGNFWDEALKPENVLVFIDTSKREDRFERQRRGSDSRENPLEAKLVTETVEKLLEMGVKPDWIGVITPYDDQRDLISSMVGEDIEVKTVDGYQGREKEIIVLSFVRSNRRGELGFLTDLRRLNVSLTRAKRKLIAVGDSSTLSNHPTYRRFIEFVRERGTFIEIDGKKH

SEQ ID NO: 65 - protein, 716 aa, Thermococcus sibiricus
MTRVQIPAGAPKYGPVAQPGQSARLISGRSGVRSPAGPPKALLKERFRELFIHKNPVITMHVKNYIAKLVDLVELEREAEIEAMREEMRRLKGYEREKVGRAILNLNGKIIGEEFGFKLVKYGRKEAFKTEIGVGDLVVISKGNPLASDLVGTVVEKGSRFIVVALETVPSWAFRNVRIDLYANDITFRRQLENLKKLSESGIRALKLILGKETPLKSSPEEFTPFDRNLNQSQKEAVSYALGSEDFFLIHGPFGTGKTRTLVELIVQEVKRGNKILATAESNVAVDNLVERLWGKVKLVRLGHPSRVSVHLKESTLAFQVESHERYRKVRELRNKAERLAVMRDQYKKPTPQMRRGLTNNQILKLAYRGRGSRGVPAKDIKQMAQWITLNEQIQKLYKFAEKIESEIIQEIIEDVDVVLSTNSSAALEFIKDAEFDVAIIDEASQATIPSVLIPIAKARRFVLAGDHKQLPPTILSEEARALSETLFEKLIELYPFKAKMLEIQYRMNQLLMEFPSREFYNGKIKADGSVKDITLADLKVREPFFGEPWDSILKREEPLIFVDTSNRTDKWERQRKGSTSRENPLEALLVREIVERLLRMGIKKEWIGIITPYDDQVDSIRSIIQDDEIEIHTVDGYQGREKEIIILSLVRSNKKGELGFLMDLRRLNVSITRAKRKLVVIGDSETLVNHETYKRLIHFVKKYGRYIELGDTGIN

SEQ ID NO: 66 - protein, 659 aa, Thermococcus paralvinellae
MNLIRYINHLKELVELEREAEIEAMREEMRKLTGYEREKVGRAVLGLNGKIIGEEFGYKLVKYGRKQEIKTEISVGDLVVISKGNPLASDLIGTVTEKGKRFLVVALETVPSWALRNVRIDLYANDITFKRQIENLDKLSESGKRALRFILGLEKPKESIDIEFKPFDEQLNESQKKAVGLALGSEDFFLIHGPFGTGKTRTVAEVILQEVKRGKKVLATAESNVAVDNLVERLWGKVKLVRLGHPSRVSKHLKESTLAYQVEIHEKYKRVREFRNKAERLAMLRDQYTKPTPQWRRGLTDRQILRLAEKGIGARGIPARVIKSMAQWITFNEKVQRLYNEAKKIEEEIVKEIIRQADVVLSTNSSAALEFIKDIKFDVAVIDEASQATIPSVLIPIAKANKFILAGDHKQLPPTILSEEAKELSETLFEKLIELYPSKAKMLEIQYRMNERLMEFPSKEFYNGKIKAYDGVKNITLLDLGVRVFSFGEPWDSILNLKEPLVFVDTSKHPEKWERQRKGSLSRENLLEAELVKEIVQKLLRMGIKPESIGVITPYDDQRDLISLLLENDEIEVKTVDGYQGREKEVIILSFVRSNKKGELGFLTDLRRLNVSLTRAKRKLIAIGDSETLSAHPTYKRFVEFVKEKGIFVQLNQYVSQTS

SEQ ID NO: 67 - protein, 701 aa, Thermus aquaticus
MGEAHPSEEALLSSLNEAQRQAVLHFEGPALVVAGAGSGKTRTVVHRVAYLIARRGVFPSEILAVTFTNKAAEEMKARLKAMVRGAGELWVSTFHAAALRILRVYGERVGLKPGFVVYDEDDQTALLKEVLKELGLAAKPGPIKSLLDRAKNQGVPPEHLLLELPEFYAGLSRGRLQDVLHRYQEALRAQGALDFGDILLYALKLLEEDGEVLKRVRKRARFIHVDEYQDTNPVQYRFTRLLAGEEANLMAVGDPDQGIYSFRAADIRNILDFTQDYPKARVYRLEDNYRSTEAILRFANAVIVKNALRLEKTLRPVKKGGEPVRLFRAESARDEARFVAEEIARLGPPFDRVAVLYRTNAQSRLLEQALASRGIPARVVGGVGFFERAEVKDLLAYARLSLNPLDAVSLKRVLNTPPRGIGPATVEKVQAIARERGLPLFEALKVAALTLPRPEPLRAFLALMEELMDLAFGPAEAFFRHLLLATDYPAYLKEAYPEDAEDRLENVEELLRAAKEAESLMDFLDKVALTARAEEPAEAEGRVALMTLHNAKGLEFPVVFLVGVEEGLLPHRSSLSTQEGLEEERRLFYVGVTRAQERLYLSYAQEREIYGRLEPVRPSRFLEEVDEGLYEVYDPYRQSSRKPTPPPHRALPGAFRGGEKVVHPRFGPGTVVAAAGDEVTVHFEGVGLKRLSLKYADLRPA

SEQ ID NO: 68 - protein, 868 aa, Thermus aquaticus
MRVYLASAGTGKTHALVEELKGLIQSGVPLRRIAALTFTRKAAEELRGRAKRAVLALSAEDPRLKEAEREVHGALFTTIHGFMAEALRHTAPLLSLDPDFALLDTFLAEALFLEEARSLLYRKGLDGGLARALLHLYRKRTLAETLHPLPGAEGVFALYLEALEGYRRRLPAFLSPSDLEALALRILENPEALRRVVERFPHILLDEYQDTGPLQGRFFQGLKEAGARLVVVGDPKQSIYLFRNARVEVFREALKQAEEVRYLSTTYRHAQAVAEFLNRFTALFGEEGVRVRPHRQEVGRVEVHWVVGEGGLEEKRRAEAHLLLDRLMALREEGYAFSQMAVLVRSRSSLPPLEAAFRARGVPYALGRGRSFFARPEVRDLYHALRLSLLEGPPGPEERLALLAFLRGPWVGLDLSEVEEALKAQDPIPLLPEAVRAKLRALRALAGLPPLEALKRLSRDEAFLRRLSPRARVNLDALLLLAAMERFPDLEALLEWLRLRAEDPEAAELPEGEEGVQVLTVHGAKGLEWPVVALFDLSRGENPKEEDLLVGLGGEVALRGTPAYKEVRKALRKAQAEEARRLLYVALSRARDVLIVTGSASGRPGPWVEALERLGLGPESQDPLVRRHPFKALPPLGDRPQTPPPPPLPAPYAHLAFPERPLPFVYSPSAFTKAKEPVPLAEALEKEALPEFYRALGTLVHYAIARHLDPEDEGAMAGLLLQEVAFPFAEGEKRRLLEEVRDLLRRYRGMLGPSLPPLEAREEDHAELPLVLPLGGTVWYGILDRLYRVGGRWYLEDYKTDREVRPEAYRFQLAIYRRALLEAWGVEAEARLVYLRHGLVHPLDPEELERALKEGFPGMGPGEGGEKA

SEQ ID NO: 69 - protein, 542 aa, Thermus aquaticus
MKGLTGSSRLRVYGPPGTGKTTWLKNEVERLLRSGVPGEEIAVCAFSRAAFREFASRLAGQVPEENLGTIHSLAYRAIGRPPLALTKDALSDWNRRVPDTWRVTPRVDGRGADLLDVMDPYEDEDSRPPGDKLYDRVAYLRNTLAPMAAWSEEERAFFQAWKSWMNAKGLVDFPGMLEAALAKPGGLGARFLLVDEAQDLTPLQLLLVEKWAQGARLALVGDDDQAIYGFMGADGASFLGVPVEDELVLGQSYRVPARVQRVAEAVIRRVQNRAPKRYAPRGDEGEVRLLWVPPEDPYHAVVDALERVNRGESVLFLATAKYLLEELKRELLRVGEPYANPYAPHRHSFNLFPQGARSAWEKARSFLFPNRIAADVKAWTKHVSSKVFAVKGEEARRYIESFPDEEKVGDDHPIWNVFRPEHRPHAVGRDVSWLLDHLLGNAPKTMRQSLMVALKSPEAVLQGRARVWIGTIHSVKGGEADWVYVWPGYTRKAAREHPDQLHRLFYVAATRARKGLVLMDQGKAPHGYVWPRVDEFWGEVWV

SEQ ID NO: 70 - protein, 1030 aa, Thermus sp.
  MOD_RES (177)..(177): Any amino acid
  MOD_RES (204)..(204): Any amino acid
  MOD_RES (232)..(232): Any amino acid
  MOD_RES (237)..(237): Any amino acid
  MOD_RES (302)..(302): Any amino acid
  MOD_RES (368)..(368): Any amino acid
  MOD_RES (517)..(517): Any amino acid
  MOD_RES (712)..(712): Any amino acid
  MOD_RES (835)..(835): Any amino acid
  MOD_RES (842)..(842): Any amino acid
  MOD_RES (844)..(845): Any amino acid
  MOD_RES (873)..(873): Any amino acid
  MOD_RES (959)..(959): Any amino acid
MEANLYVAGAGTGKTYTLAERYLGFLEEGLSPLQVVAVTFTERAALELRHRVRQMVGERSLGHKERVLAELEAAPIGTLHALAARVCREFPEEAGVPADFQVMEDLEAALLLEAWLEEALLEALQDPRYAPLVEAVGYEGLLDTLREVAKDPLAARELLEKGLGEVAKALRLEAWRXLRRRMEELFHGERPEERYPGFPKGWRXEEPEVVPDLLAWAGEVKFNKKPWLEYKXDPALXRLLKLLGGVKEGFSPGPADERLEEVWPLLRELAEGVLARLEERRFRARRLGYADLEVHALRALEXEEVRAYYRGRFRRLLVDEFQDTNPVQVRLLQALFPDLRAWTVVGDPNQSIYSFRRADPKVMERFQXEAAKEGLRVRRLEKSHRYHQGLADFHNRFFPPLLPGYGAVSAERKPEGEGPWVFHFQGDLEAQARFIAQEVGRLLSEGFQVYDLGEKAYRPMSLRDVAVLGRTWRDLARVAEALRRLEVPAVEAGGGNLLETRAFKDAYLALRFLGDPXDEEALVGLLRSPFFALTDGEVRRLAEARGEGETLWEVLEREGDLSAEAERARETLRGLLRRKALEAPSRLLQRLDGATGYTGVAARLPQGRRRVKDWEGTLDLVRKLEVGSEDPFLVARHLRLLLRSGLSVERPPLEAGEAVTLLTVHGAKGLEWPVVFVLNVGGWNRLGSWKNNKTKPLFRPGLALVPPVLDEXGNPSALFHLAKRRVEEEEKQEENRLLYVAATRASERLYLLLSPDLSPDKGDLDPQTLIGAGSLEKGLEATEPERPWSGEEGEVEVLEERIQGLPLEALPVSLLPLAARDPEAARRRLLGEPEXEGGEAWXPXXPQETEEEVPGGAGVGRMTHALLERFEAXEDLEREGRAFLEESFPGAEGEEVEEALRLARTFLTAEVFAPYRGNAVAKEVPVALELLGVRLEGRADRVGEDWVLDYKTDRGVDAXAYLLQVGVYALALGKPRALVADLREGKLYEGASQQVEEKAEEVLRRLMGGEGQGRQPYPLAATDPGHGAPG

SEQ ID NO: 71 - protein, 693 aa, Thermus sp.
  MOD_RES (292)..(292): Any amino acid
  MOD_RES (446)..(446): Any amino acid
  MOD_RES (632)..(632): Any amino acid
  MOD_RES (636)..(636): Any amino acid
  MOD_RES (678)..(678): Any amino acid
  MOD_RES (691)..(691): Any amino acid
MSDALLAPLNEAQRQAVLHFEGPALVVAGAGSGKTRTVVHRVAYLVARRGVFPSEILAVTFTNKAAEEMRERLRGLVPGAGEVWVSTFHAAALRILRVYGERVGLRPGFVVYDEDDQTALLKEVLKELALSARPGPIKALLDRAKNRGVGLKALLGELPEYYAGLSRGRLGDVLVRYQEALKAQGALDFGDILLYALRLLEEDEEVLRLVRKRARFIHVDEYQDTSPVQYRFTRLLAGEEANLMAVGDPDQGIYSFRAADIKNILDFTRDYPEARVYRLEENYRSTEAILRXANAVIVKNALRLEKALRPVKRGGEPVRLYRAEDAREEARFVAEEIARLGPPWDRYAVLYRTNAQSRLLEQALAGRGIPARVVGGVGFFERAEVKDLLAYARLALNPLDAVSLKRVLNTPPRGIGPATWARVQLLAQEKGLPPWEALKEAARTFXRAEPLRHFVALVEELQDLVFGPAEAFFRHLLEATDYPTYLREAYPEDAEDRLENVEELLRAAKEAEDLQDFLDRVALTAKAEEPAEAEGKVALMTLHNAKGLEFPVVFLVGVEEGLLPHRNSLSTLEGLEEERRLFYVGITRAQERLYLSHAEEREVYGRREPARPSRFLEEVEEGLYEVYDPYRXPKPXPPPHRPRPGAFRGGERVVHPRFGPGTVVAAQGDEVTVHFEGXGLKRLSLKYAELXPA

SEQ ID NO: 72 - protein, 692 aa, Thermus sp.
MDEALLSSLNEAQRQAVLHFQGPALVVAGAGSGKTRTVVHRVAYLIAHRGVYPTEILAVTFTNKAAEEMRERLKGMVRGAGEVWVSTFHAAALRILRVYGERVGLKPGFVVYDEDDQTALLKEVLKELGLSAKPGPIKALLDRAKNRGEPPEALLAELPEYYAGLSRRRLLDVFFRYQEALKAQGALDFGDILLYALRLLEEDQEVLARVRKRARFIHVDEYQDTNPVQYRFTKLLAGEEANLMAVGDPDQGIYSFRAADIKNILQFTADFPGAKVYRLEENYRSTEAILRFANAVIVKNALRLEKTLRPVKRGGEPVRLFRAKDAREEARFVAEEILRLGPPFDRIAVLYRTNAQSRLLEQALAGRGVGARVVGGVGFFERAEVKDLLAYARLALNPLDSVSLKRILNTPPRGIGPATVEKVARLAQEKGLPLFEALKRAELLPRPEPVRHFVALMEELMDLAFGPAEAFFRHLLQATDYPAYLREAYPEDHEDRLENVEELLRAAKEAESLLDFLDKVALTARAEEPAGAEGKVFLMTLHNAKGLEFPVVFLVGVEEGLLPHRNSLNTLEALEEERRLFYVGVTRAQERLYLSYAEEREVYGRLEATRPSRFLEEVEEGLYQEYDPYRSPRPVPPSHRPKPGAFKGGEKVVHPRFGPGTVVAASGDEVTVHFEGVGLKRLSLKYADLRPA

SEQ ID NO: 73 - protein, 670 aa, Salinisphaera hydrothermalis
MALPKLNPQQDAAMRYLDGPLLVLAGAGSGKTGVITRKIAHLIARGYDARRVVAVTFTNKAAREMKQRASKLISADDARGLTVSTFHSLGLQMIREEHAALGYKPRFSIFDSEDADKVLADLVGRDGDHRKATKAAISNWKSALIDPETATAQATGSDIPLARAYGEYQRRLKAYNAVDFDDLLALPVHLLSTDHEARERWQSRFRYLLVDEYQDTNAAQYEMMRLLAGARAAFTVVGDDDQSIYAWRGARPGNIADLSRDFPHLKVIKLEQNYRSVGNVLSAANQLIGASNQRAYEKTLWSAMGPGDRVRVIAAPDEAGEAERIASEISSHKLRLGTAYGDYAILYRGNFQSRAFEKALRERDIPYRVSGGRSFFERSEIRDLVTYLKLMVNPDDDAAFLRIVNLPRREIGPATLEALGRYAGSRHISLFDAARGIGLAGGVGERSGRRLADFVDWLRNLTQDSEGMTPRELVSQLIVDIDYRNWLRDTSANTKAARKRIENLDDFIGWLDRLDNAEDGKPVTLEDVVRRLSLMDFANQSEKDVENQVHLLTLHAAKGLEFDHVFLAGLEEGMLPHHACLEDDKIEEERRLLYVGITRARKTLALTYARKRRRGGEESDSVPSRFLEELPADELDWPSATGTRSKAANAEQGRDQVAALRAMLGASADS

SEQ ID NO: 74 - protein, 665 aa, Thermus filiformis
MPQVGFTDHFFKGLEALSREEQNRVREAVFAFMQDPKHPSFKLHRLEDIKTDRFWSARVSKDLRLILYHHPEMGWIFAYVGHHDDAYRWAETHQAEVHPKLGLLQIFRVVEEVRVEPRKIKPLLPDYPDDYLLDLGVPPSYLKPLRLVETEDQLLGLIEGLPQDVQERLLDLAAGRPVTLPPKLAPSEEWFKHPLSRQHIHFIQNLDELRQALSYPWERWMVFLHPAQREAVERVFQGPARVTGPAGTGKTVVALHRAAALARRYPEEPLLLTTFNRFLASRLRSGLQRLLGEVPPNLTVENLHSLARRLHEQHVGPVKLVKEEDYGPWLLEAAQGLEYGKNFLLSEFAFADAWGLYTWEAYRGFPRTGRGVPLTARERLKLFGAFQKVWGRMENEGALTFNGLLHRLRQRAEEGALPRFRAVVVDEAQDLGPAELLLVRALAQEAPDSLFFALDPAQRIYKSPLSWQALGLEVRGRSIRLKVNYRTTREIAKRAEAVLPKEVEGEMREVLSLLQGPEPEIRGFPTQEACQAELVRWLRWLLEQGVRPEEVAVLARVRKLAEGLAEGLRRAGIPVVLLSDQEDPGEGVRLGTVHSAKGLEFRAVALFGANRGLFPLESLLREAPSEADREALLAQERNLLYVAMSRARERLWVGYWDEGSPFLTP

SEQ ID NO: 75 - protein, 706 aa, Meiothermus ruber
MSDLLSSLNPSQREAVLHFEGPALVVAGAGSGKTRTVVHRIAYLLRERRVYPAEILAVTFTNKAAGEMKERLEKMVGRSARDLWVTTFHAAAVRILRTYGEYVGLKPGFVIYDEDDQNTLLKEVLKELELEAKPGPFRSMIDRIKNRGAGLAEYMREAPDFIGGVPRDVAAEVYRRYQNSLRMQGALDFNDLLLLTIELFEQHPEVLHKVQQRARFIHVDEYQDTNPVQYRLTRLLAGERPNLMVVGDPDQSIYGFRNADINNILDFTKDYPGARVIRLEENYRSSSSILRVANAVIEKNALRLEKVLRPTKPGGEPVRLYRAPNAREEAAFVAREIVKLGGYQQVAVLYRTNAQSRLLEEHLRRANVPVRLVGAVGFFERREIKDLLAYGRVAVNPDDSINLRRIVNTPPRGIGATTVARLVEHAQKTGITVFEAFRAAEQVISRPQQVQAFVRLLDELMEAAFESGPTAFFQRVLEQTGFREALKQEPDGEDRLQNVEELLRAAQDWEEEEGGSLADFLDSVALTAKAEEPQGDAPVEAVTLMTLHNAKGLEFPTVFLVGLEENLLPHRNSLHRLEDLEEERRLFYVGITRAQERLYLSYAEERETYGKREYTRPSRFLQDIPQDLLKEVGAFGDGETRVLSQARPEPKPRTQPAEFKGGEKVKHPKFGSGTVVAAMGGEVTVMFPGVGLKRLAVKFAGLERLE

SEQ ID NO: 76 - protein, 710 aa, Thermus sp.
MQGPQSSHPGDELLRSLNEAQRQAVLHFEGPALVVAGAGSGKTRTVVHRVAYLIAKRGVFPSEILAVTFTNKAALEMRERLKRMVKGAGELWVSTFHSAALRILRVYGERVGLKPGFVVYDEDDQTALIKEVLKELGLAARPGPLKALLDRAKNRGEAPESLLSELPDYYAGLSRGRLLDVLKRYEEALKAQGALDFGDILLYALRLLEEDPEVLKRVRRRARFIHVDEYQDTNPVQYRFTKLLAGEEANLMAVGDPDQGIYSFRAADIKNILEFTRDFPGAKVYRLEENYRSTEAILRFANALIVNNALRLEKTLRPVKPGGEPVRLYRARDARDEARFVAEEILRLGPPFDRVAVLYRTNAQSRLLEQALASRGVPARVVGGVGFFERAEVKDLLAYARLSLNPLDGVSLKRVLNTPPRGIGPATVEKVEALAREKGLPLFEALRVAAEVLPRPAPLRHFLALMEELQELAFGPAEGFFRHLLEATDYPAYLREAYPEDHEDRLENVEELLRAAKEAEGLMEFLDKVALTARAEEPGEPAGKVALMTLHNAKGLEFPVVFVVGVEEGLLPHRSSLSTLEGLEEERRLFYVGVTRAQERLYLSYAEEREVYGRTEATRPSRFLEEVEGGLYEEYDPYRASAKVSPSPAPSEARASKPKPGAYRGGEKVIHPRFGQGTVVAAMGDEVTVHFEGVGLKRLSLKYADLRPVG

SEQ ID NO: 77 - protein, 693 aa, Thermus thermophilus
MSDALLAPLNEAQRQAVLHFEGPALVVAGAGSGKTRTVVHRVAYLVARRGVFPSEILAVTFTNKAAEEMRERLRGLVPGAGEVWVSTFHAAALRILRVYGERVGLRPGFVVYDEDDQTALLKEVLKELALSARPGPIKALLDRAKNRGVGLEALLGELPEYYAGLSRGRLADVLVRYQEALKAQGALDFGDILLYALRLLKEDEEVLRLVRKRARFIHVDEYQDTSPVQYRFTRLLAGEEANLMAVGDPDQGIYSFRAADIKNILDFTRDYPEARVYRLEENYRSTEAILRLANAVIVKNALRLEKALRPVKRGGEPVRLYRAEDAREEARFVAEEIARLGPPWDRYAVLYRTNAQSRLLEQALAGRGIPARVVGGVGFFERAEVKDLLAYARLALNPLDAVSLKRVLNTPPRGIGPATWARVQLLAQEKGLPPWEALKEAARTSSRVEPLRHFVALVEELQDLVFGPAEAFFRHLLEATDYPTYLREAYPEDAEDRLENVEELLRAAKEAEDLQDFLDKVALTAKAEEPAEAEGKVALMTLHNAKGLEFPVVFLVGVEEGLLPHRNSLSTLEGLEEERRLFYVGITRAQERLYLSHAEEREVYGRREPARPSRFLEEVEEGLYEVYDPYRVPKPAPPPHRPRPGAFRGGERVVHPRFGPGTVVAAQGDEVTVHFEGFGLKRLSLKYAELRPA

SEQ ID NO: 78 - protein, 708 aa, Thermus scotoductus; identical to SEQ ID NO: 56

SEQ ID NO: 79 - protein, 621 aa, Thermus scotoductus; identical to SEQ ID NO: 57

SEQ ID NO: 80 - protein, 719 aa, Oceanithermus profundus
MSARDLLSSLNEQQQAAVQHFLGPALVIAGAGSGKTRTVVHRVAYLLAEREVYPAEVLAVTFTNKAAGEMRERLSRMVGRAAGELWVSTFHSASLRILRRYGERIGLKPGFVVYDDDDQRVLLKEVLGSLGLEARPTYVRAVLDRIKNRMWSVDEFLAHADDWVGGLTKQQMAEVYARYQQRLAENNAVDFNDLLLRTIELFERHPEALEAVRQRARFIHVDEYQDTNPAQYRLTKLLAGDEANLMVVGDPDQSIYGFRNADIQNILGFERDYRGAVVYRLEANYRSTAAILRVANALIERNQQRLEKTLRPVKPAGEPVRLYRAPDHREEAAFVAREVARLAGERALDDFAVLYRTNAQSRVLEEAFRRLNLPARIVGGVGFYERREVKDVLAYARLAVNPADDVALRRVINVPARGVGAASVGKLAAWAQAQGVSLLEAAHRAGELLAARQAAAVAKFTDLLTTLREAAEGTGPEAFLRLVLAETGYSEMLRREGDSEPRLENLEELLRAAAEWEEEHGGSVAEFLDEIALTARAEEPNAAPEKSVTLMTLHNAKGLEFPVVFVVGVEEGLLPHRSSLGSDAEIEEERRLLYVGITRAQERLYLTLSEERETWGQRERVRPSRFLEEIPEDFLKPVGPFGDAHEPAPAPLSSAPVNRAAKGSASGFRGGEKVRHPRYGEGTVVATSGEGARQEVTVHFAEAGLKRLLVKYAGLERIE

SEQ ID NO: 81 - protein, 917 aa, Oceanithermus profundus
MKVRIASAGTGKTYALTSRFTAALAEHPPYRLAAVTFTRSAAAELKARLRERLLAIAAGRFQPSGAEDVPPEAVVRRAGALATEVLGATVTTIHGFFAELLRQNALALGLEPDFLRIDASESQQIFAEEARAYVYLNEEDDALAEVLGRLFAKRSLAAELRPQGEAAEALWAHFRAVLERYARRLGGEALGPADIELHAWRLLERAGREEALAARIRSRLARVFVDEYQDTSPLQGRVFAALEALGVEVEVVGDPKQSIYAFRNADVEVFREAMRRGEPLPPLVTSWRHDRALVRFLNRYVDWVAEERPEAFARAEAPPVEARPDAGPGRVRLQLVQGEARQDALRPYEADQLARWLQERHAEHAWRDMAVLVRSHSSVPLLVRALAAHGLPHVVVGGRGFYDLIEVRDLVHAARVALDPRGRFSLAAFLRGPFAGLDLGRVERVLAAEDPLAELERAAPEVAERVDRLVRWVQTLRPLDFFERMVRTPFLEGASYLERLEPPARANVDQLLFKLASRRYGRLEFLLRDLEDLRGSDEAGVPEGGFDAVRIYTMHGSKGLEWPVVAVFDLNRGQPDGAEPFYVRPGSGEFAAEGDPDYPRFAAEWKERERQEAYRLLYVALSRPRSRLLLSLSVQLKPDGEGLRPKFWRRTLGRTLIEEMNLAAWDALEVERLDAARLPAPKAAAAAPRRAADVDERLRAPVEPLARPPVYSPSALKAERPAPPELDDEGDVAVELEEPGVDPGLVARTVGILVHYAIGQDWGPERLQDLWNQEAVQRLTEPERTRVKTEVAQRLETYWRLLGTELPALDERDEDYAEFPLLLPTRTARLDTVWEGVIDRLYRVGDVWVLEDYKTDRELHPERYHFQLALYRRAVAAAWGIEPEARLVYLRFGEVVPLEAQLLEEAFERGTREAEEV

SEQ ID NO: 82 - protein, 889 aa, Oceanithermus profundus
MKVIVASAGTGKTTRLTQRYLEHLEQHPPQRVAAVTFTNKAAAELRERIFEALGRGSFYDFTPSPALAERLADYQVRVLEAPIGTIHSFFGYLLRLTAPMLGLDPHFEVIDPATARAWFLEEVRNLAIIEGAEVDETVTTALVELFKRRSISEAFEGTGDASRSLVAGFKKVYARWLTRLGGRYLDPSEIERRALALIRHPEALERVRSRLGVVLVDEYQDTAPIQARVFEALEEAGVPIEVVGDPKQSIYAFRDADVEGFREAHRRARENGNVETLTVSYRHPPALADFLNAFTSAEAALGKAFTAEEAPEVKPGREGDARVELITVTPGDGKATLDALRNGEARLLARELRRLHDEEGYDYGQMLVLFRRRHQLPPLLRALRGAGLPFAVVGLRGLYEEPEVRELYHALRLATGEAPRDSLAVFLSGPFGGLTLGQVREVLAQDAPESYLTLHHPEAAERLLRLRADAEKMRPAEALTRLIEAPTAKGPPFLDLLELEMADTVLYVLGRIEHTRTYPEAVATLESFRSGGEEEASLARLGGDAVRVMSAHAAKGLQAPVVVIFDADRTFNGNSDELVIEPRTGRVALNGEDAYESIAQALKARKEGEDHRLIYVALSRSSERLIVSAAVKEPRKGSWLHHLTEVLNLGSKFEHRNVTLAEIALEEPIEQEAATLPVDPELATPLPPAPPAVSSPTALKAERELEVPDPEEAWPADPEARLLGRIVGILVHEGIQRDWDPDDPEVLLALEGEQVLEEVPADRRPAVIEEVATLLRVYRTLLGSAIPSLEEREVDLAELPLVYPLGATAWEGVIDRLYRVGDVWYLEDYKTDREVHPERYHSQLALYREAVRKHWGIEPEVRLVYLRTGQVVPLDAAALKEGLASYTGG

SEQ ID NO: 83 - protein, 638 aa, Oceanithermus profundus
MNEHERVIAHEVGPAAVVAGAGSGKTRAATLRAARLARTGERVGLVTFTASAAEEMRQRVLAEDVPAKHVWAGTFHSLAFQILRQFPEAGGYEGFPEVLTPNDELRLFRRLWAELLDQDLDAELRRKLVKALGFFRKARAEEALEGWAARAGESLELDAEMLEALMISFQLRKREAGLASFDDLIEGASRALGDKDVRKWADRRFPFLIVDEYQDTSRAQETFLAALMPGEAPNLMVIGDPNQAIYGWRGAGSRTFERFQARYPQAVLYPLRKNYRSTRAVLRLAERAIARLYRSGQEAYYRLEGVKEEGEPPVLLTPPNAAAEATDVAREVARAVASGVPPEEIAVLARSSMQLAGVEDRLARLGVATRLLGGIRLSERREVKTLVQLLKAAWSLHERALVDFIEEAVPGLGERTLTRVEHAARPYNLVDRIMNDGAFVRGFSTRVQQGLFMTRTLLQLARATFEGVTGEAFAERFREFAQDLYGELLPGYLARIGKQGPNEEARRRHLERFVATVEAFAREEAEGGLDDLLARLAFLEQQDGPAVTLGTVHAVKGLEFEVVFVVGMVEGAFPILADDSDPEEERRLFYVAATRAKRRLYLSAPTYGPRGKILQPSRYLEEALDEGLVRLQKVRPAA

SEQ ID NO: 84 - protein, 606 aa, Oceanithermus profundus
MVSEGRWKIERVVYLKDGFAVVAVRNEAGERHTAVGEMPTPVEGTWVRMETEHTVHPRYGPRLRVVRFLGLAPPPSKELAKIEGYLKLGFSEEAASWLAARFGSRPERAFDKPQELLVPGVPREVLRRVFPRLERLLGGLIDLLGEGHTAAPLFLLAERSGLGKEEIQELAREARKQRLIVEEQGRYGLVQPYRTERSIADGLLFRLKPGRGLRLTPPAGHGLSDEQARIFKLVRENRVVVLTGGPGSGKTTTIATLLAAPELHRMRFGIAAPTGKAARRIAEVARLPAETIHRLLGLGEARRPLYHARNPLPYDLLVIDETSMLDAEIAAFLVDALAPSTSVIFVGDPDQLPPVGPGQFLRDLMTRVATLRLTQIFRQAQDSPIVNGAYALREGRMPLADGERLRLLPFEEEAAQTTLRTLLDELQRLEQIVGERPQVLVPGNRGPLGVRRLSPFLQQQLNPGGKPLGPIGWGMEAREGDPAVWIHNDYELGIMNGEVGVLRGGGSLGLTFETPTDRFAIPGNKRSRLVLAYAMTVHRSQGSEWPAVITILPKAHMALLSRELVYTALTRSKQYHTLLFHPEALYRARAVQASRRYTWLDVLLRG

SEQ ID NO: 85 - protein, 693 aa, Thermus oshimai
MTAPGHPDALLAPLNPAQQEAVLHFQGPALVVAGAGSGKTRTVVHRVAYLMAHRGVYPGEILAVTFTNKAAEEMKGRLKALVPGAGELWVATFHSAALRILRVYGEAIGLKPGFVVYDEADQEALLKEVLKELGLSAKPGPLKALLDRAKNRGEAWEALEIPDYYAGLPKGKVLDVLRRYQEALRAQGALDFGDILVYALRLLEENPEVLAKVRKRARFIHVDEYQDTSPVQYRFARLLAGEEANLMAVGDPDQGIYSFRAADIRNILDFTRDFPGARVYRLEENYRSTEAILRFANAVIQKNRLRLEKTLRPVKPGGEPVRVYAAPEAREEARFVAEEIFRLGPPYERFAVLYRTNAQSRLLEQALAAKGLPYRVVGGVGFFERAEVKDLLAYARLSLNPEDGVSLKRVLNTPPRGIGPATLARLEALAQAEGVPLLGAIRLGAERFPKPEPLRAFLALLDELADLAFGPPEAFFRHLLSATDYLQYLKEHHPEDAEDRLENVEELLRAAKEAQDLQEFLDRVALTARADQDGGRGVALMTLHNAKGLEFPVVFLVGVEEGLLPHQSSLSTLEGLEEERRLFYVGVTRAQDRLYLSYAREREVYGRREPRRMSRFLEEVPEGLYLPHDPYRQGAQPKPAPRAQGAFRGGEKVVHPRFGPGTVVAASGDEVTVHFEGVGLKRLSLKYADLRPA

SEQ ID NO: 86 - protein, 694 aa, Thermus oshimai
MASSLSKAELVPTPEQEKALHLYRSRQDFKLVAVAGSGKTTTLRLMAESFPRRHIAYLAFNRAMKEEARRKFPPNTRVFTLHALAYRRTVPGTPYEAKFRLGNGQVRPVHVRERLQVDPLLAYVVRSGLERFIRSGDPEPLPRHLPRDWRKTVEARGPSGFAEVERAVKGVALLWKAMRDPKDPFPLSHDGYVRIWREEGAGGDPPAGVILVDEAQDLDPNFLTVLSGWRGKAQQVFVGDPRQQIYGWRGAVNAMGEIDLPESPLTWSFRFGEPLASFVQAVTARQTQGLVPLVGRAGWATEVHVNLFPTPPFTILTRSNLGLVTALLEGAQLFSLQKEEAHVVGGVEELVWLLTDLQAIKEGGERPRPHPELLGISKWEEVESLAEYSIVLNRLLRLAKEYDLEALAHKIAQLHGPEEGAKLVLSTAHKAKGREWDRVLLWEDFYWVAAYRWFFPNTAPPPSEPSPEFLEEENIFYVAMTRARLGLHISLPEALAEEEAKRILDRLSQGVPSGEDRGEDERGETLPAPFTGPTPVSPKEATFPLPSLYDRLLSEALNGGRDPLLHLLRDDLARLSALSPTPLPPEVAQALWERARPEEALGAIREGLGAMWREDPYELLRAINALALLGGRNPRKLAKILGDRFPGGEEAEDLLFVARARKRELMGRSLAEFWRGLGASVRHPLLKAYARARS

SEQ ID NO: 87 - protein, 854 aa, Thermus oshimai
MRLYVASAGTGKTETLMGELKALLEGGVPLRRVAAVSFTRKSAEELRLRVRRLLEAHREAFWAREALREVHGALFTTLHGFMAEALRHTAPFLGLDPDFRVMDGFLAQALFLEEARSLLFLEGHPEAPELLELLEALYEKRSLAEAFTPLPGAEGLLALYERVLARYRARTQEVLGPGDLEAKALLLLRHPEALGRVAERFSHLLVDEFQDVNPLQGRFLRALEEAGVRVVAVGDPKQSIYLFRNARVEVFLRARAAAEEVRALSRTHRHAKQVVELLNRFTTRFFRAEEGNRVEGVREAEGRVEVHWVLGKLEEARRAEARLLAQRLLALRAEGIPFGEMAVLVRARTSLPPLEKALRAAGVPFVRGRGQSFFARPEVRDLYHALRLALAERPYALEDRLSLLAFLRSPFLGLDLSELEEALRAEDPWPLLPKGVQEALEGLRALALLPPLEALRRLARDEGFLRRISRRARANLDTLLLLAAGARFPTLEDLLLWLALRAKDPESVELPEGGGGVTLLTVHGAKGLEWPVVALYDVSRGPSERPPPLLVDEEGRVALKGTEAYRALLKEAERAEREEALRLLYVALSRARDLLLITGSTSQRPGPWAEALQALGLGPDAQDPWVETHPLEAIPPLPPIPQAPQDPRPAPYTPWRGEPRARPPVYSPSAHLKAEAEPLEVLGEGEALPEWARAVGTLVHYAIARHLDPEDEGAMGGLLRQEVALAFGEGEREALLEEVRALLRAYRSLLSGALPPLEARAEDHAELPLLLPHKGTVWYGVLDRLYRVGDRWYLDDYKTDQKVRPEAYRFQLALYRKAVLEAWGVEAEARLVYLRHRQVVPLSPAELEAALEGL

SEQ ID NO: 88 - protein, 799 aa, Thermomonospora curvata
MSSSQVTGRPTTVKDAEIAVEQRRVDQAHARLEEMRAEAQAMIEEGYRQALAGTKGSLVDRDAMVYQAALRVQALNVADDGLVFGRLDLADGQTRYIGRIGVRTRDHEPMVIDWRAPAAEAFYRATPEDPQGVVRRRVLHTRGRTVVDLEDDLLDPSAADSLTIVGDGAFIASLARTREGTMRDIVATIQREQDEVIRAPADGTVLVRGAPGTGKTAVALHRVAYLLFRHRRRFGSRGVLVVGPNRRFTAYIERVLPSLGEGSATLRSLGDLVEGVSATVHDPPELAALKGSAAMAPVLRRAVTDHPPGAPDKLRVVHGGVVVELGRPQLDKLRTSLHRRSTGSVNASRRRVAEALLDALWERYVHTGGTEPEPDEPVQGELALWEGILAEGGLAPLDEQDRPSSPADRTSREAFVKNVREQRAFTDFLTAWWPIRRPLDVLRSLGDAARLRRAAGRDLDRAQVELLAASWRRALAGDPPTLSYQDIALLDEIDALLGPPPQPSRATAREEDPYVVDGIDILTGEVVADEDWEPGLQELTTTIERLERARRVDDEVADVRPEYAHIVVDEAQDLSPMQWRMLGRRGRQATWTIVEDPAQSAWEDLEEARKAMEAALDGPAARRGRSRRPRRRPRHEYELTTNYRNTTEIAAVSARVLRLALPEARPARAVRSSGHRPVIDLVPEEELQAAARRAVRTLLEQVEGTIGVIVPLPGDAWGESDRRALSAGFPERVQVLDVLEAKGLEFDAAVICAPETIAAQSPRGLRVLYVAVSRATQRLTVLTADPVWRRRLAGGESAR

SEQ ID NO: 89 - protein, 503 aa, Thermodesulfatator indicus
MTSISLDQYQEQAVKAKGNTLVVAGPGAGKTRVLLAKAIHLLEQGIDPEKVLILTFTIKTTQELKERLASIGIKGVKVDTFHALAYDLLKAKGIKPRLATEEELKALARDLSKRKGLSLKDFRKALDKGENHYRSLWEEALKLHGLYDFSLLLKEATGHYLQQEKVYLLIDEFQDLNPELTSFLKTFTKAEFFLVGDPAQAIYGFRGACPQVIKEFVDYLAPQIYFLKKSYRVPEKVLNFAETLRETQGFPLEPLEAVQKGGNRLGLSFNKPFNEAKGVAKLVSELLGGLQMEASQRGLAPPEIAILSRVRTLLNPIKEAFIKFGIPFQVPSENLKEEISAIESLSDIAKSIKSLKELEAYLAEGPSSVKEAWLESQSLEGFLFRLEMLKTFASISIRKDGVPLLTIHEAKGLEFKVVILVGAEDGLLPFTLLEDYDLAEEKRVAYVAVTRAQESFYFTQVKTGRFLYGHKLSGKVSPFFETLPIKEKSSKTKPKARQKKLFG

SEQ ID NO: 90 - protein, 807 aa, Geobacillus stearothermophilus
MTISVIDELLEKNKQNMNKTAKDAVEAQLIAYAKKEVKKLQEIRPHPYFGRLDFEDEFGRETIYIGKKGLEKDGELIVVDWRTDLGRLYNAYQGVQKTFQIGKENRPVTIHGKRGIVIKNGKVIKVTDIGKSEIIENDNGEKVKYMDDYLKEILTNTEEAHRLRDIIASIQAEQDEIIRLPLKDTIIVQGAAGSGKSTIALHRISYLLYQYHEQVKPKDILILAPNEIFLSYIKDIVPEIEIEGIEQRTFYDWASTYFTDVHDIPDLHEQYVHIYGSTEKEDLIKIAKYKGSLRFKKLLDDFVEYIGNTMIPHGDVVIESGVILSKEEIHQFYHAKEHLPLNVRMKEVKEFIINWRNEQINIRKQQIEDEFEEAYRKWVVTLPEGEERKAVYEALEKAKQLRMKIFQEKMQHEISLIVKKMENIPALLMYKSVFQKKVFEKFHPDIDEELLSLLLKNGRQIKQERFMYEDIAPLIYLDAKINGKKLQYEHIVIDEAQDYSPFQLAIMKDYAKSMTILGDIAQGIFSFYGLDRWEEIESYVFKEKEFKRLHLQTSYRSTKQIMDLANRVLLNSNYDFPLVIPVNRPGDVPTIKKVESIGELYDEIVNSIRIFEEKGYKKIAILTASKQGAIDTYDQLMRRQITQMEVITEGHQALKEKIVIIPSYLVKGLEFDAVIIEDVSDETFKDETQHAKMLYMSITRAHHDLHLFYRGNISPLLEERDPSAPPKPRKSFADWLITDINDPYVEPQVEAVKRVKKEDMIRLFDDEEEEFVEEAFEDDRERYYDFHAWLKVWRRWAEMRKQLDEKS

SEQ ID NO: 91 - protein, 696 aa, Coprothermobacter proteolyticus; identical to SEQ ID NO: 54

SEQ ID NO: 92 - protein, 646 aa, Meiothermus silvanus
MNDPIRHKEGPALVFAGAGAGKTRTLTQRVKWLVEEGEDPYSITLVTFTNKAAGEMKERIARLVEAPLAEAVWVGTFHRFCLQSLQVYGREIGLEKVAVLDSAAQRKLAERIIAGLFPAKPPRGFTPMAALGAVSRAANSGWDDIQLATMYADLTEKIVNFRWAYEEAKKGLGALDYDDLLLRGVRLLKLSEGAARMVRRRAAYLMVDEFQDTNGVQLELVRAIAPGTSPNLMVVGDPDRSIYGWRGANYRTILEFRQHYPGAAVYGLYTNYRSQAGVVEVANRIIAQNATRKPEMQEAHLPQSEEPFLLVAKNRWEEAHFVAQAVEFYRGQGIALEEMAVLMRANFLSRDLEQALRLRGIPYQFTGGRSFFERREIQLGMAVLKVLANPKDSLAVAALVEEMVEGAGPLGIQKVLEAAKAANLSPLEAFRNPAMVKGLRGKEVQAEAMRLAEVLQDQVARLAAEAPEYHALLKETLDRLGFEAWLDRLGEESEQVYSRKANLDRLLQGMQEWQEVNPGAPLQDLVGTLLLEAGDTPAEEGQGVHLMTVHASKGMEFRVVFVIGLNEGLFPLSKASSSFEGLEEERRLMYVAVTRAKEVLHLSYAADGVVSRFAQEARVPVEEYDPRLGWSGRQNQQALKALLEIA

SEQ ID NO: 93 - protein, 737 aa, Anaerolinea thermophila; identical to SEQ ID NO: 55

SEQ ID NO: 94 - protein, 769 aa, Thermoanaerobacterium thermosaccharolyticum
MDINGQIIKLNRNKTQGTLKLTNGQKIKFKINSDSVKPIFLYEYYKFKGNMIEDTLIIDDIYGIANDININDFTELFPSVAHDKINNICNRFNVLHVGNLIDLINDENFITVVNDTIGEEKATIFLSNLQKIKDRQEYIDVWDIIKKTNPTFDINVPIKIVNALKYRASMNNITVSQLIKESPWIIEQLDIFDSITERKKIAENIATHYGLSNDSNKAVISYAIAMTNNYIQQGHSYIPYYTLVSRVSNSLKLDFNKVNDTLKFLPNDNKSGYLIRDNKYKDEIENEYNSDKKIGYSVYLPKIFHMEKYIADIISSILKKKSTINKIELQKNLKLYRSENKLIFSKEQEEAIFSISDNKITVITGGAGTGKTTVIKAIIDLVNKMGYTPVVLAPTGIASQRVAPNVGSTIHKYARIFDTYDPVFDEIEENKENNSGKVIIVDEMSMITVPVFAKLLSVTLDADSFIFVGDPNQLPPIGAGGVFEALIELGNKNINNINTVVLNQSFRSKNSIVKNAQNILEDKPIYEDDNLNIIEAKSWNKIADEVVNLIRKLLDNGVQYSDIMVLSSKRGEGKNGVSLLNERIRKEIFNNKGKYAVGDIVITTRNDYDNKSSYFRSKELKKYINSIRHEERPTIFNGTVGVIKDISDNEVIIEYNTPMPVEAKYNMEELDWYIEYGFAITVHKAQGGQAKYIIFASDEPRNISREMLYTAITRCKNGKVFLIGGENEDWKIKKEHSFVLSKLKYRILDNIHQQEKESKINSKIVLINQ

SEQ ID NO: 95 - protein, 706 aa, Meiothermus ruber
MSDLLSSLNPSQQEAVLHFEGPALVVAGAGSGKTRTVVHRIAYLLRERRVYPAEILAVTFTNKAAGEMKERLEKMVGRPARDLWVSTFHAAAVRILRTYGEYVGLRPGFVIYDEDDQNTLLKEVLKELELEAKPGPFRAMIDRIKNRGAGLAEYMREAPDFIGGVPKDAAAEVYRKYQSGLRMQGALDFNDLLLLTIELFEQHPEVLHKVQQRARFIHVDEYQDTNPVQYKLTRLLAGERPNLMVVGDPDQSIYGFRSADINNILDFTKDYPGARVIRLEENYRSSSSILRVANAVIEKNALRLEKVLRPTRPGGEPVRLYRAPNAREEAAFVAREIVKLGNFQQIAVLYRTNAQSRLLEEHLRRANVPVRLVGAVGFFERREIKDLLAYGRVAVNPADSINLRRIVNTPPRGIGATTVSRLVEHAQKTGTTVFEAFRVAEQVISRPQQVQAFVRLLDELIEAAFESGPTAFFQRVLEQTGFREALKQEPDGEDRLQNVEELLRAAQDWEEEEGGSLSDFLDSVALTAKAEEPQGDAPAEAVTLMTLHNAKGLEFPTVFLVGLEENLLPHRNSLHRLEDLEEERRLFYVGITRAQERLYLSYAEERETYGKREYTRPSRFLEDIPQDLLKEVGAFGDSEVRVLPQARPEPKPRTQLAEFKGGEKVRHPKFGSGTVVAAMGGEVTVMFPGVGLKRLAVKFAGLERLE

SEQ ID NO: 96 - protein, 920 aa, Meiothermus ruber
MKVRVASAGTGKTASLVLRYLELIAKGTPLRRIAGVTFTRKAADELRVRVAAAIEEVLQTGRHLSFVASGGSRAAFQEAAREIAGATLSTIHGFMAQCLRLAAPLLHLDPDFSMLGDWEAQAIFEEEWQTLRYLAQDAHHPLFGLVSDELTEPLLHLFSRRSQAEVFEPAAGEANQHLLQVYQTVYAAYEARLGANLLSPSELERKALELARNDRAMKRVLERVRVLLVDEYQDVNPVQGAFFAALEQARLPIEIVGDPKQSIYAFRNADVSVFRKALREGKSEPPLTHSYRHSRVLVRFLNGLTGYLAKEGLGFGLEEAPPVEGVRPEQGRLEVHWVVGELPLEELRKQEARVLAGRLAALRGPIEYSQMAVLVRSYGSVRFLEEALAEAQIPYVLLQGRGYYERQEVRDLYHALRAALDPRGLSLAVFLRSPFGQHTEAGPLKPLELPQIEGVLRADDPLGRLAQHWPSVYERLRQIQAQVRLMAPLEVLKFLIRAPLMDGRPYHDFLEPRARENVDALLFYFAPRPPQNLEGLLERLELLSRQADAGDVPQSGEGVQILTVHQAKGLEWPLVAVFDLGRMNVHRPQPLYLGQGPNGGDGGRLRRWVALPETPQFEAFRQQVKLQEEEESYRLLYVAASRARDTLLLTASASHGQPEGWGKVLEAMNLGPASKPYHRPDFHLQTWPYQPAPPVRVLSQPAPLQPSPWVDARFEPEPFPPLFSPSALKRLEAEPLPLPDPEEGEAVPGRARAIGTLVHYAIGQNWRPDNPQHLANLEAQEVMFPFGPDERRGIMAEVQALLEHYQELLGRALPWPRDEDYPEFAVALPLGSTVWQGVIDRLYRVGQQWYLEDYKTDQEMRPERYLVQLGIYLAAIRQAWQIEPEVRLVYLRFGWVERLDKAILEAALGEIMPKGEGLRR

SEQ ID NO: 97 - protein, 745 aa, Deinococcus radiodurans
MTSSAGPDLLQALNPTQAQAADHFTGPALVIAGAGSGKTRTLIYRIAHLIGHYGVHPGEILAVTFTNKAAAEMRERAGHLVPGAGDLWMSTFHSAGVRILRTYGEHIGLRRGFVIYDDDDQLDIIKEVMGSIPGIGAETQPRVIRGIIDRAKSNLWTPDDLDRSREPFISGLPRDAAAEAYRRYEVRKKGQNAIDFGDLITETVRLFKEVPGVLDKVQNKAKFIHVDEYQDTNRAQYELTRLLASRDRNLLVVGDPDQSIYKFRGADIQNILDFQKDYPDAKVYMLEHNYRSSARVLEAANKLIENNTERLDKTLKPVKEAGQPVTFHRATDHRAEGDYVADWLTRLHGEGRAWSEMAILYRTNAQSRVIEESLRRVQIPARIVGGVGFYDRREIRDILAYARLALNPADDVALRRIIGRPRRGIGDTALQKLMEWARTHHTSVLTACANAAEQNILDRGAHKATEFAGLMEAMSEAADNYEPAAFLRFVMETSGYLDLLRQEGQEGQVRLENLEELVSAAEEWSQDEANVGGSIADFLDDAALLSSVDDMRTKAENKGAPEDAVTLMTLHNAKGLEFPVVFIVGVEQGLLPSKGAIAEGPSGIEEERRLFYVGITRAMERLLMTAAQNRMQFGKTNAAEDSAFLEDIEGLFDTVDPYGQPIEYRAKTWKQYRPTVPAATTAVKNTSPLTAELAYRGGEQVKHPKFGEGQVLAVAGVGERQEVTVHFASAGTKKLMVKFANLTKL

SEQ ID NO: 98 - protein, 610 aa, Thermodesulfobium narugense
MDLNLNEDQKRAVYSDSRALLIVAGAGTGKTRVLTTRAARLIKENPDARYLLLTFTKKAAREMTTRVRELIEEDTKNRLYSGTFHSFCSNIIRRRSERVGLTNDFVIIDESDSLDLMKKVFSRIYSKEKIDSLIFKPKDILSLYSYARNNNQDFIEIVQRKYKYVNFEDIKKIISLYELNKKERNYLDFDDLLMYGLLAIKTLEKSPFDEVLVDEFQDTNQIQAEMLYYFYDLGSRISAVGDDAQSIYSFRGAYYENMFNFIKRLDAEKIILSSNYRSTQQILDIANSIIQSSYSSIKKELVANVRLKENVKPKLVIVSDDWEEARYVAREMQKFGEKGLKVAALYRAAYIGRNLESQLNSMGIKYSFYGGQKLTESAHAKDFMSFLRVFVNPKDEIALIRILKMFPGIGEKKAEKIKDAVISGDNLKKALSKEKNLEELNIFFDKLFKITDWHDLLELVFDFYKDIMNRLYPENYEEREEDLIKFMDMSSNYDNLVEYLEAFTLDPVEKSEFDNNNVILSTIHSAKGLEFDVVFLLSVIESVYPHFRAQSTDEIEEERRLFYVAITRAKQRLIFTFPRHSKKSRGYFAKNTISPFLREKDNYLEVFIAR

SEQ ID NO: 99 - protein, 692 aa, Thermus thermophilus
MSDALLAPLNEAQRQAVLHFEGPALVVAGAGSGKTRTVVHRVAYLVARRGVFPSEILAVTFTNKAAEEMRERLRGLVPGAGEVWVSTFHAAALRILRVYGERVGLRPGFVVYDEDDQTALLKEVLKELALSARPGPIKALLDRAKNRGVGLKALLGELPEYYAGLSRGRLGDVLVRYQEALKAQGALDFGDILLYALRLLEEDEEVLRLVRKRARFIHVDEYQDTSPVQYRFTRLLAGEEANLMAVGDPDQGIYSFRAADIKNILDFTRDYPEARVYRLEENYRSTEAILRFANAVIVKNALRLEKALRPVKRGGEPVRLYRAEDAREEARFVAEEIARLGPPWDRYAVLYRTNAQSRLLEQALAGRGIPARVVGGVGFFERAEVKDLLAYARLALNPLDAVSLKRVLNTPPRGIGPATWARVQLLAQEKGLPPWEALKEAARTFSRPEPLRHFVALVEELQDLVFGPAEAFFRHLLEATDYPAYLREAYPEDAEDRLENVEELLRAAKEAEDLQDFLDRVALTAKAEEPAEAEGRVALMTLHNAKGLEFPVVFLVGVEEGLLPHRNSVSTLEGLEEERRLFYVGITRAQERLYLSHAEEREVYGRREPARPSRFLEEVEEGLYEVYDPYRRPPSPPPHRPRPGAFRGGERVVHPRFGPGTVVAAQGDEVTVHFEGFGLKRLSLKYAELKPA

SEQ ID NO: 100 - protein, 656 aa, Dictyoglomus thermophilum
MNNQFDSEKKIFIIPSRKKKEFLERIEKDLNEEQRKVVLEADGPSLVIAGPGSGKTRTIVYRVGYLVALGYSPKNIMLLTFTNQAARHMINRTQALIRESIEEIWGGTFHHVGNRILRVYGKIIGINEQYNILDREDSLDLIDECLEELFPEENLGKGILGELFSYKVNTGKNWDEVLKIKAPQIIDKIEIVQKVFERYEKRKRELNVLDYDDLLFFWYRLLLESEKTRKILNDRFLYILVDEYQDTNWLQGEIIRLTREENKNILVVGDDAQSIYSFRGATIENILSFPEIFPGTRIFYLVFNYRSTPEIINLANEIIKRNTRQYFKEIKPVLKSGSKPKLVWVRDDEEEAQFVVEVIKELHKEGVKYKDIGVLFRSNYHSMAVQMELTLQGIPYEVRGGLRFFEQAHIKDMISLLKILFNPQDEISAQRFFKLFPGIGRAYAKKLSQVLKESKDFDKIFQMQFSGRTLEGLRILKNIWDKIKVIPVQNFSEILRVFFNEYYKDYLERNYPDFKDREKDVDQLILLSERYDDLEKFLSELTLYTYAGEKLLEEEEEEKDFVVLSTIHQAKGLEWHAVFILRLVQGDFPSYKSMDNIEEERRLFYVAVTRAKRELYVITYLTRKVKDMNVFTKPSIFLEELPYKELFEEWIVQREI

SEQ ID NO: 101 - protein, 722 aa, Thermus thermophilus
MLSPFGGEEETKAIPLEEEILLAWRVFSAALPPNFLAPVSASLHTLVREAEGKEGAELEAYAWERLEELARTSVVKDAIQSFLEVAAEKPEVLRAGLLWFRTWNRLSPEEREALYRKAERFKPTAELASKASFLQGPPPPPKPLSPSVQAARSSPPRFTPTPEQEEAVRAFLSREDMKLVAVAGSGKTTTLRLMAQSAPKERLLYVAFNRSVRDEAERTFPGNVEVLTLHGLAHRHVVRGSGAYQRKLAARNGRVTPGDVLEALELPRERYALAYVIRSTLEAFLRSASEVPTPAHIPPEYREVLQRRDKDPFSERYVLKAVRLIWKLMQDPDDSFPLSFDGFVKIWAQAGAKIRGYDAVLVDEAQDLSPVFLQVLEAHRGELRRVYVGDPRQQIYGWRGAVNAMDKLDAPERKLTWSFRFGEDLARGVRRFLAHVGSPIELHGKAPWDTEVSLARPEPPYTALCRTNAGAVEAVTSFLLEEGREGARVFVVGGVDEIAWLLRDAHLLKVGGEREKPHPELALVENWEELEELAKEVNHPQARMLVRLARRYDLLELARLLKHAQADEEGKADLVVSTLHKAKGREWDRVVLWGDFIPVWDEKVREFYRKQGALDELKEEENVVYVALTRARRFLGLDQLPDLHERFFQGEGLVKPPSVSPLSVGGAGVSADLLRELEVRVLAKLEDRLKEVAEVLAALLVEEASKAVAEAMREMGLLGEEG

SEQ ID NO: 102 - protein, 692 aa, Thermus thermophilus
MSDALLAPLNEAQRQAVLHFEGPALVVAGAGSGKTRTVVHRVAYLVARRGVFPSEILAVTFTNKAAEEMRERLRGLVPGAGEVWVSTFHAAALRILRVYGERVGLRPGFVVYDEDDQTALLKEVLKELALSARPGPIKALLDRAKNRGVGLKALLGELPEYYAGLSRGRLGDVLVRYQEALKAQGALDFGDILLYALRLLEEDEEVLRLVRKRARFIHVDEYQDTSPVQYRFTRLLAGEEANLMAVGDPDQGIYSFRAADIKNILDFTRDYPEARVYRLEENYRSTEAILRFANAVIVKNALRLEKALRPVKRGGEPVRLYRAEDAREEARFVAEEIARLGPPWDRYAVLYRTNAQSRLLEQALAGRGIPARVVGGVGFFERAEVKDLLAYARLALNPLDAVSLKRVLNTPPRGIGPATWARVQLLAQEKGLPPWEALKEAARTFPRAEPLRHFVALVEELQDLVFGPAEAFFRHLLEATDYPTYLREAYPEDAEDRLENVEELLRAAKEAEDLQDFLDRVALTAKAEEPAEAEGKVALMTLHNAKGLEFPVVFLVGVEEGLLPHRNSLSTLEGLEEERRLFYVGITRAQERLYLSHAEEREVYGRREPARPSRFLEEVEEGLYEVYDPYRRPPSPPPHRPRPGAFRGGERVVHPRFGPGTVVAAQGDEVTVHFEGVGLKRLSLKYAELKPA

SEQ ID NO: 103 - protein, 1014 aa, Thermus thermophilus
MEANLYVAGAGTGKTYTLAERYLGFLEEGLSPLQVVAVTFTERAALELRHRVRQMVGERSLGHKERVLAELEAAPIGTLHALAARVCREFPEEAGVPADFQVMEDLEAALLLEAWLEEALLEALQDPRYAPLVEAVGYEGLLDTLREVAKDPLAARELLEKGLGEVAKALRLEAWRALRRRMEELFHGERPEERYPGFPKGWRTEEPEVVPDLLAWAGEVKFNKKPWLEYKGDPALERLLKLLGGVKEGFSPGPADERLEEVWPLLRELAEGVLARLEERRFRARRLGYADLEVHALRALEREEVRAYYRGRFRRLLVDEFQDTNPVQVRLLQALFPDLRAWTVVGDPNQSIYSFRRADPKVMERFQAEAAKEGLRVRRLEKSHRYHQGLADFHNRFFPPLLPGYGAVSAERKPEGEGPWVFHFQGDLEAQARFIAQEVGRLLSEGFQVYDLGEKAYRPMSLRDVAVLGRTWRDLARVAEALRRLEVPAVEAGGGNLLETRAFKDAYLALRFLGDPKDEEALVGLLRSPFFALTDGEVRRLAEARGEGETLWEVLEREGDLSAEAERARETLRGLLRRKALEAPSRLLQRLDGATGYTGVAARLPQGRRRVKDWEGTLDLVRKLEVGSEDPFLVARHLRLLLRSGLSVERPPLEAGEAVTLLTVHGAKGLEWPVVFVLNVGGWNRLGSWKNNKTKPLFRPGLALVPPVLDEEGNPSALFHLAKRRVEEEEKQEENRLLYVAATRASERLYLLLSPDLSPDKGDLDPQTLIGAGSLEKGLEATEPERPWSGEEGEVEVLEERIQGLPLEALPVSLLPLAARDPEAARRRLLGEPEPEGGEAWEPDGPQETEEEVPGGAGVGRMTHALLERFEAPEDLEREGRAFLEESFPGAEGEEVEEALRLARTFLTAEVFAPYRGNAVAKEVPVALELLGVRLEGRADRVGEDWVLDYKTDRGVDAKAYLLQVGVYALALGKPRALVADLREGKLYEGASQQVEEKAEEVLRRLMGGDRPEA

SEQ ID NO: 104 - protein, 704 aa, Thermus sp.
MDAFPSGKPLDEAWLSSLNEAQRQAVLHFEGPALVVAGAGSGKTRTVVHRVAYLMARRGVYPSEILAVTFTNKAAEEMRERLKAMVKGAGELWVSTFHAAALRILRFYGERVGLKPGFVVYDEDDQTALLKEVLKELGVSAKPGPIKALLDRAKNRGEPPERLLADLPEYYAGLSRGRLLDVLHRYQQALWAQGALDFGDILLLALKLLEEDPEVRKRVRKRARFIHVDEYQDTSPVQYRLTKLLAGEEANLMAVGDPDQGIYSFRAADIKNILQFTEDFPGAKVYRLEENYRSTERILRFANAVIVKNALRLEKTLRPVKSGGEPVRLFRARDAREEARFVAEEVLRLGPPYDRVAVLYRTNAQSRLLEQALASRGIGARVVGGVGFFERAEVKDLLAYARLALNPLDAVSLKRVLNTPPRGIGPATVEKVQAIAQEKGLPLYEALKVAAQVLPRPEPLRHFLALMEELMDLAFGPAEAFFRHLLEATDYPAYLKEAYPEDLEDRLENVEELLRAAREAEGLMDFLDKVALTARAEEPGEAGGKVALMTLHNAKGLEFPVVFLVGVEEGLLPHRSSVSTLEGLEEERRLFYVGVTRAQERLYLSYAEEREVYGRPEASRPSRFLEEVEEGLYEEYDPYRLPPPKPVPPPHRAKPGAFRGGEKVVHPRFGLGTVVAASGDEVTVHFDGVGLKRLSLKYADLRPA

SEQ ID NO: 105 - protein, 741 aa, Deinococcus geothermalis
MPDLPASSLLAQLNPNQAQAANHYTGPALVIAGAGSGKTRTLVYRIAHLIGHYGVDPGEILAVTFTNKAAAEMRERARHLVEGADRLWMSTFHSAGVRILRAYGEHIGLKRGFVIYDDDDQLDILKEIMGSIPGIGAETHPRVLRGILDRAKSNLLTPADLARHPEPFISGLPREVAAEAYRRYEARKKGQNAIDFGDLITETVRLFQEVPAVLERVQDRARFIHVDEYQDTNKAQYELTRLLASRDRNLLVVGDPDQSIYRFRGADIQNILDFQKDYLDAKVYMLEQNYRSSARVLTIANKLIENNAERLEKTLRPVKEDGHPVLFHRATDQRAEGDFVAEWLTRLHAEGMRFSDMAVLYRTNAQSRVIEESLRRVQIPAKIVGGVGFYDRREIKDVLAYARLAINPDDDVALRRIIGRPKRGIGDTALERLMEWARVNGTSILTACAHAQELNILERGAQKAVEFAGLMHAMSEAADNDEPGPFLRYVIETSGYLDLLRQEGQEGQVRLENLEELVSAAEEWSRENEGTIGDFLDDAALLSSVDDMRTKQENKDVPEDAVTLMTLHNAKGLEFPVVFIVGTEEGLLPSKNALLEPGGIEEERRLFYVGITRAMERLFLTAAQNRMQYGKTLATEDSRFLEEIKGGFDTVDAYGQVIDDRPKSWKEYRPTESARPGAVKNTSPLTEGMAYRGGEKVRHPKFGEGQVLAVAGLGDRQEVTVHFPSAGTKKLLVKFANLTRA

SEQ ID NO: 106 - protein, 551 aa, Thermus thermophilus
MALRPTEEQLKAVEAYRSGQDLKVVAVAGSGKTTTLRLMAEATPGKRGLYLAFNRSVQQEAARKFPRNVRPYTLHALAFRMAVARDEGYRAKFQAGKGHLPAQAVAEALGLRNPLLLHAVLGTLEAFLRSEAASPDPGMIPLAYRTLRAGTKTWPEEEAFVLRGVEALWRRMTDPKDPFPLPHGAYVKLWALSEPDLSFAEALLVDEAQDLDPIFLKVLEAHRGRVQRVYVGDPRQQIYGWRGAINAMDRLEAPEARLTWSFRFAETLARFVRNLTALQDRPVEVRGKAPWATRVDAALPRPPFTVLCRTNAGVVGAVVVTHEVHRGRVHVVGGVEELVHLLRDAALLKKGEKRTDPHPDLAMVETWEELEALAEAGYAPAYGVLRLAQEHPDLEALAAYLERAWTPVEVAAGVVVSTAHKAKGREWDRVVLWDDFYPWWEEGAAARVNWGSDPAHLEEENLLYVAATRARKHLSLAQIRDLLEAVDRMGVYRVAEEATRAYLLLSAEVLRGVATDPRVPAEHRVRALKALGYLERGEEALDSPGKPGGQG

SEQ ID NO: 107 - protein, 692 aa, Thermus thermophilus
MSDALLAPLNEAQRQAVLHFEGPALVVAGAGSGKTRTVVHRVAYLVARRGVFPSEILAVTFTNKAAEEMRERLRGLVPGAGEVWVSTFHAAALRILRVYGERVGLRPGFVVYDEDDQTALLKEVLKELALSARPGPIKALLDRAKNRGVGLKALLGELPEYYAGLSRGRLGDVLVRYQEALKAQGALDFGDILLYALRLLEEDEEVLRLVRKRARFIHVDEYQDTSPVQYRFTRLLAGEEANLMAVGDPDQGIYSFRAADIKNILDFTRDYPEARVYRLEENYRSTEAILRFANAVIVKNALRLEKALRPVKRGGEPVRLYRAEDAREEARFVAEEIARLGPPWDRYAVLYRTNAQSRLLEQALAGRGIPARVVGGVGFFERAEVKDLLAYARLALNPLDAVSLKRVLNTPPRGIGPATWARVQLLAQEKGLPPWEALKEAARTFPRPEPLRHFVALVEELQDLVFGPAEAFFRHLLEATDYPAYLREAYPEDAEDRLENVEELLRAAKEAEDLQDFLDRVALTAKAEEPAEAEGRVALMTLHNAKGLEFPVVFLVGVEEGLLPHRNSVSTLEGLEEERRLFYVGITRAQERLYLSHAEEREVYGRREPARPSRFLEEVEEGLYEVYDPYRRPPSPPPHRPRPGAFRGGERVVHPRFGPGTVVAAQGDEVTVHFEGFGLKRLSLKYAELKPA

SEQ ID NO: 108 - protein, 716 aa, Marinithermus hydrothermalis
MDLLRDLNPAQREAVQHYTGPALVVAGAGSGKTRTVVHRIAYLIRHRGVYPTEILAVTFTNKAAGEMKERLARMVGPAARELWVSTFHSAALRILRVYGEYIGLKPGFVVYDEDDQLALLKEVLGGLGLETRPQYARGVIDRIKNRMWSVDAFLREAEDWVGGLPKEQMAAVYQAYEARMRALGAVDFNDLLLKVIGLFEAHPEVLHRVQQRARFIHVDEYQDTNPAQYRLTRLLAGAERNLMVVGDPDQSIYGFRNADIHNILNFEKDYPDARVYRLEENYRSTEAILRVANAVIEKNALRLEKTLRPVRSGGDPVFLYRAPDHREEAAFVAREVQRLKGRGRRLDEIAVLYRTNAQSRVLEEAFRRQNLGVRIVGGVGFYERREVKDVLAYARAAVNPADDLAVKRVLNVPARGIGQTSLAKLSQLAETARVSFFEALRRAGEVLARPQAQAVQRFVALIEGLANAAYDTGPDAFLRLVLAETGYADMLRREPDGEARLENLEELLRAAREWEEQHAGTIADFLDEVALTARAEEPEGEVPAEAVTLMTLHNAKGLEFPVVFIVGVEEGLLPHRSSTARVEDLEEERRLFYVGITRAQERLYLTLSEERETYGRREAVRASRFLEDIPEAFLQPLSPFGEPLGAGREPVAVRPTRRSSAAGGFRGGEKVRHPRFGQGLVVAASGEGDRQEVTVHFAGVGLKKLLVKYAGLERIE

SEQ ID NO: 109 - protein, 59 aa, Escherichia coli
KIAHLIRGCGYQARHIAAVTFTNKAAREMKERVGQTLGRKEARGLMISTFHTLGLDIIK

SEQ ID NO: 110 - protein, 58 aa, Escherichia coli
RIAWLMSVENCSPYSIMAVTFTNKAAAEMRHRIGQLMGTSQGGMWVGTFHGLAHRLLR

SEQ ID NO: 111 - protein, 58 aa, Mycobacterium tuberculosis
RIAYLMAARGVGVGQILAITFTNKAAAEMRERVVGLVGEKARYMWVSTFHSTCVRILR

SEQ ID NO: 112 - protein, 58 aa, Mycoplasma capricolum
KIAYLIEKQNIDPSRILAVTFTNKAAKEMKERVLQITNNSFKSPFISTFHSWCSKVLR

SEQ ID NO: 113 - protein, 57 aa, Deinococcus radiodurans
RIAHLIGHYGVHPGEILAVTFTNKAAAEMRERAGHLVPGAGDLWMSTFHSAGVRILR

SEQ ID NO: 114 - protein, 58 aa, Geobacillus stearothermophilus
RIAYLMAEKHVAPWNILAITFTNKAAREMRERVQSLLGGAAEDVWISTFHSMCVRILR

SEQ ID NO: 115 - protein, 58 aa, Bacillus subtilis
RIAYLMAEKHVAPWNILAITFTNKAAREMKERVESILGPGADDIWISTFHSMCVRILR

SEQ ID NO: 116 - protein, 58 aa, Staphylococcus aureus
RIAYLLDEKDVSPYNVLAITFTNKAAREMKERVQKLVGDQAEVIWMSTFHSMCVRILR

SEQ ID NO: 117 - protein, 59 aa, Leuconostoc citreum
RIAHLVQDLNVFPWRILAITFTNKAAREMRERIAALLSEDVARDIWVSTFHALAVRILR

SEQ ID NO: 118 - protein, 59 aa, Fructobacillus fructosus
RVAHLIEDLDVRPWRILAITFTNKAAREMRERIAKLVDPEQAQAVWVSTFHALAVRILR

SEQ ID NO: 119 - protein, 58 aa, Staphylococcus epidermidis
RIAYLLDEKDVSPYNILAITFTNKAAKEMKARVEHLVGEEAQVIWMSTFHSMCVRILR

SEQ ID NO: 120 - protein, 58 aa, Carnobacterium maltaromaticum
RIAYLIEEKQVNPWNILAITFTNKAAKEMKERVNRLNVRGGNDVWVSTFHSMCVRILR

SEQ ID NO: 121 - protein, 58 aa, Alloiococcus otitis
RIAYLIQEKGVNPWNILAITFTNKAAGEMKDRVQKLVSQGGSGVWVSTFHSMCVRILR

SEQ ID NO: 122 - protein, 57 aa, Mitsuokella multacida
RIANLLAQGVAPYSILAITFTNKAATEMRERVDRMIGDAAKDVWLSTFHSFCARFLR

SEQ ID NO: 123 - protein, 58 aa, Alkaliphilus metalliredigens
RIAYLVEELGVSPYHILSITFTNKAAREMKERIHQLLGDGFRDLWVSTFHSSCVRILR

SEQ ID NO: 124 - protein, 57 aa, Desulfotomaculum reducens
RIAQILSQGVRPYNILAITFTNKAANEMRARVENLVPQAAKDLWVTTFHSACLRILR

SEQ ID NO: 125 - protein, 58 aa, Listeria fleischmannii
RIAYLIKEREVNPYNILAITFTNKAAREMKARVTGLLGGIAESIWMSTFHSMCVRILR

SEQ ID NO: 126 - protein, 59 aa, Sporosarcina newyorkensis
RIAYLVVEKQVYPSNILAITFTNKAAREMRERIDGLLGAGSGERMWVSTFHSMCVRILR

SEQ ID NO: 127 - protein, 59 aa, Kurthia massiliensis
RIAYLVIEKAVNPWNILAITFTNKAAREMRDRIDGLLGNGSGQQMWVSTFHSMCVRILR

SEQ ID NO: 128 - protein, 58 aa, Marinococcus halotolerans
RIAYLIREKMIPPYAILAITFTNKAAKEMKERVGKLVGPVAEDIWMSTFHSMCVRILR

SEQ ID NO: 129 - protein, 59 aa, Planococcus antarcticus
RIAYLVLEKQVYPSNILAITFTNKAAREMRNRIDGLLGHGTGQRMWASTFHSMCVRILR

SEQ ID NO: 130 - protein, 59 aa, Lysinibacillus fusiformis
RIAYLVIEKEVYPSKILAITFTNKAAREMRDRIDGILGNGTGDSMWVSTFHSMCVRILR

SEQ ID NO: 131 - protein, 58 aa, Oceanobacillus iheyensis
RIAYLMGEKDVSPRNILAITFTNKAAREMKERVSKLVGPQGEYMWVSTFHSMCVRILR

SEQ ID NO: 132 - protein, 58 aa, Virgibacillus sp.
RIAYLLEEKDVAARNILAITFTNKAAREMKERVRRLVGSESDQMWVSTFHSMCVRILR

SEQ ID NO: 133 - protein, 58 aa, Caldibacillus debilis
RIAYLIAEKGVNPYNILAITFTNKAAREMKERVEKIIGGTAAEVWISTFHAMCVKILR

SEQ ID NO: 134 - protein, 58 aa, Halobacillus halophilus
RIAYLLSEKDVAPRNILAITFTNKAAREMKDRVESLVGKDGEKIWMSTFHSMCVRILR

SEQ ID NO: 135 - protein, 58 aa, Gracilibacillus halophilus
RIAYLLGEKEVSPRNILAITFTNKAAREMKERITDLVGSRGADMWVSTFHSMCVRILR

SEQ ID NO: 136 - protein, 58 aa, Bacillus cereus
RIAYLLGEKGVAPWNVLAITFTNKAAREMRERIDTLVGPEAEDIWISTFHSMCVRILR

SEQ ID NO: 137 - protein, 58 aa, Macrococcus caseolyticus
RIAYLIDEKDVSPYKILAITFTNKAAKEMKERVKKIIGDESDVIWISTFHSMCVRILR

SEQ ID NO: 138 - protein, 58 aa, Laceyella sacchari
RVAYLLAEKGIHPWNVLAITFTNKAAREMKERIGQLVGPMAEEIWISTFHSMCVRMLR

SEQ ID NO: 139 - protein, 60 aa, Brevibacillus laterosporus
RISYLVGYKQAFPWSILAITFTNKAAREMKERVERMVGRDAGADDIWISTFHSLCVRILR

SEQ ID NO: 140 - protein, 59 aa, Paenibacillus sp.
RIAYLIATRKAPPWAILAITFTNKAAREMQDRVSRLVGGPEGRDIWVSTFHSMCVRILR

SEQ ID NO: 141 - protein, 58 aa, Thermobacillus composti
RIAYLIGKKRVAPWSILAITFTNKAAREMQERVEALVGPGASDIWVSTFHSMCVRILR

SEQ ID NO: 142 - protein, 58 aa, Amphibacillus xylanus
RIAYLLDEKDVSPRNILAITFTNKAAREMKDRVTNLIGPEADQMWVSTFHSMCVRILR

SEQ ID NO: 143 - protein, 53 aa, Escherichia coli
WQNKIRYLLVDEYQDTNTSQYELVKLLVGSRARFTVVGDDDQSIYSWRGARPQ

SEQ ID NO: 144 - protein, 53 aa, Escherichia coli
YRERFTNILVDEFQDTNNIQYAWIRLLAGDTGKVMIVGDDDQSIYGWRGAQVE

SEQ ID NO: 145 - protein, 60 aa, Mycobacterium tuberculosis
YRRRFRHVLVDEYQDTNHAQYVLVRELVGRDSNDGIPPGELCVVGDADQSIYAFRGATIR

SEQ ID NO: 146 - protein, 53 aa, Mycoplasma capricolum
WRNAYDYVLVDEFQDTNELQFSLIKFLTINTNHLTVVGDPDQTIYSWRGAKLD

SEQ ID NO: 147 - protein, 53 aa, Deinococcus radiodurans
VQNKAKFIHVDEYQDTNRAQYELTRLLASRDRNLLVVGDPDQSIYKFRGADIQ

SEQ ID NO: 148 - protein, 53 aa, Geobacillus stearothermophilus
YQYKFQYIHIDEYQDTNRAQYTLVKKLAERFQNICAVGDADQSIYRWRGADIQ

SEQ ID NO: 149 - protein, 53 aa, Bacillus subtilis
YQRKFQYIHVDEYQDTNRAQYMLVKQLAERFQNLCVVGDSDQSIYRWRGADIT

SEQ ID NO: 150 - protein, 53 aa, Staphylococcus aureus
YQNKFQYIHVDEYQDTNKAQYTLVKLLASKFKNLCVVGDSDQSIYGWRGADIQ

SEQ ID NO: 151 - protein, 53 aa, Leuconostoc citreum
YQQQFEYLHVDEYQDTNDAQYTIVNLLAQRSKNLAVVGDADQSIYGWRGANMN

SEQ ID NO: 152 - protein, 53 aa, Fructobacillus fructosus
YQDQFRYLHVDEYQDTNDAQYKIVNMLAQGSKNLAVVGDADQSIYGWRGANMQ

SEQ ID NO: 153 - protein, 53 aa, Staphylococcus epidermis
YQNKFQYIHVDEYQDTNKAQYTLVKLLANKFKNLCVVGDSDQSIYGWRGADIQ

SEQ ID NO: 154 - protein, 53 aa, Carnobacterium maltaromaticum
YQNKFHYIHVDEYQDTNHAQYTLVNTLAKRFKNLCVVGDADQSIYGWRGANME

SEQ ID NO: 155 - protein, 53 aa, Alloiococcus otitis
YQAKFQYIHVDEYQDTNQAQYQLVQLLAQRFKNVCVVGDADQSIYGWRGADMG

SEQ ID NO: 156 - protein, 53 aa, Mitsuokella multacida
YQGRFRYILVDEYQDTNGAQYQLTKILAARHHNLCVVGDADQSIYGWRGADIR

SEQ ID NO: 157 - protein, 53 aa, Alkaliphilus metalliredigens
YQEKFKYILVDEFQDTNMAQYTLVSLLAKKHHNLCVVGDDDQSIYGWRGADIR

SEQ ID NO: 158 - protein, 53 aa, Desulfotomaculum reducens
YQNKFKYILVDEYQDTNHTQYVLVNMLAESHRNVCVVGDPNQSIYKWRGADIN

SEQ ID NO: 159 - protein, 53 aa, Listeria fleischmannii
YQRKFQYIHVDEYQDTNHAQYLLVKLFAAKLRNLCVVGDSDQSIYGWRGADIS

SEQ ID NO: 160 - protein, 53 aa, Sporosarcina newyorkensis
YQNKFQYIHVDEYQDTNFSQYRLVQMLASKFRNVCVVGDSDQSIYRWRGADIG

SEQ ID NO: 161 - protein, 53 aa, Kurthia massiliensis
YQNKFHYIHVDEYQDTNKSQYLLVKLLASKFKNLCVVGDSDQSIYRWRGADIT

SEQ ID NO: 162 - protein, 53 aa, Marinococcus halotolerans
YQRKFQYIHVDEYQDTNRAQYMLVNMLAAKRHNLCVVGDSDQSIYKWRGADIQ

SEQ ID NO: 163 - protein, 53 aa, Planococcus antarcticus
YQNKFHYIHVDEYQDTNNAQYQLVQKLASKFKNICVVGDSDQSIYRWRGADIT

SEQ ID NO: 164 - protein, 53 aa, Lysinibacillus fusiformis
YQNKFQYIHVDEYQDTNKSQYLLVQLLAKKFKNICVVGDSDQSIYRWRGADIG

SEQ ID NO: 165 - protein, 53 aa, Oceanobacillus iheyensis
YQRRFQYIHVDEYQDTNHAQYYLVKQLASRFQNLCVVGDSDQSIYRWRGADIG

SEQ ID NO: 166 - protein, 53 aa, Virgibacillus sp.
YQRRFQYIHVDEYQDTNHAQYQLVKQLASRYQNLCVVGDSDQSIYRWRGADIT

SEQ ID NO: 167 - protein, 53 aa, Caldibacillus debilis
YQRKFQYIHVDEYQDTNRAQYELVRLLSARFQNICVVGDSDQSIYRWRGADIS

SEQ ID NO: 168 - protein, 53 aa, Halobacillus halophilus
YQRRFQYIHVDEYQDTNHAQYQLVKQLASRYKNLCVVGDSDQSIYAWRGADIQ

SEQ ID NO: 169 - protein, 53 aa, Gracilibacillus halophilus
YQRRFQYIHVDEYQDTNHAQYYLVKQLASRFQNLCVVGDSDQSIYAWRGADIS

SEQ ID NO: 170 - protein, 53 aa, Bacillus cereus
YQRKFQYIHVDEYQDTNKAQYLLVKHLAARFKNLCVVGDSDQSIYRWRGADIS

SEQ ID NO: 171 - protein, 53 aa, Macrococcus caseolyticus
YQSKFQYIHVDEYQDTNRAQYLLVKMLADKFKNICVVGDSDQSIYGWRGADIY

SEQ ID NO: 172 - protein, 53 aa, Laceyella sacchari
YQRKFQYIHVDEYQDTNHVQYILTKMLAEKHQNLCVVGDSDQSIYRFRGADIT

SEQ ID NO: 173 - protein, 53 aa, Brevibacillus laterosporus
YQRKFKYIHVDEYQDTNRAQYMLISMLADMHKNICCVGDADQSIYKWRGADIS

SEQ ID NO: 174 - protein, 53 aa, Paenibacillus sp.
YQKKFQYIHVDEYQDTNRAQYMLCRMLADKHHRICVVGDSDQSIYRWRGADIS

SEQ ID NO: 175 - protein, 53 aa, Thermobacillus composti
YQNKFRYIHVDEYQDTNRAQYLLCRMLADKHHNICVVGDSDQSIYRWRGADIT

SEQ ID NO: 176 - protein, 53 aa, Amphibacillus xylanus
YQRRFQYIHVDEYQDTNYAQYDLVKKLAEKYQNLCVVGDSDQSIYRWRGADIK

SEQ ID NO: 177 - protein, 724 aa, Geobacillus stearothermophilus
MNFLSEQLLAHLNKEQQEAVRTTEGPLLIMAGAGSGKTRVLTHRIAYLMAEKHVAPWNILAITFTNKAAREMRERVQSLLGGAAEDVWISTFHSMCVRILRRDIDRIGINRNFSILDPTDQLSVMKTILKEKNIDPKKFEPRTILGTISAAKNELLPPEQFAKRASTYYEKVVSDVYQEYQQRLLRNHSLDFDDLIMTTIQLFDRVPDVLHYYQYKFQYIHIDEYQDTNRAQYTLVKKLAERFQNICAVGDADQSIYRWRGADIQNILSFERDYPNAKVILLEQNYRSTKRILQAANEVIEHNVNRKPKRIWTENPEGKPILYYEAMNEADEAQFVAGRIREAVERGERRYRDFAVLYRTNAQSRVMEEMLLKANIPYQIVGGLKFYDRKEIKDILAYLRVIANPDDDLSLLRIINVPKRGIGASTIDKLVRYAADHELSLFEALGELEMIGLGAKAAGALAAFRSQLEQWTQLQEYVSVTELVEEVLDKSGYREMLKAERTIEAQSRLENLDEFLSVTKHFENVSDDKSLIAFLTDLALISDLDELDGTEQAAEGDAVMLMTLHAAKGLEFPVVFLIGMEEGIFPHNRSLEDDDEMEEERRLAYVGITRAEEELVLTSAQMRTLFGNIQMDPPSRFLNEIPAHLLETASRRQAGASRPAVSRPQASGAVGSWKVGDRANHRKWGIGTVVSVRGGGDDQELDIAFPSPIGIKRLLAKFAPIEKV

SEQ ID NO: 178 - protein, 720 aa, Escherichia coli
MDVSYLLDSLNDKQREAVAAPRSNLLVLAGAGSGKTRVLVHRIAWLMSVENCSPYSIMAVTFTNKAAAEMRHRIGQLMGTSQGGMWVGTFHGLAHRLLRAHHMDANLPQDFQILDSEDQLRLLKRLIKAMNLDEKQWPPRQAMWYINSQKDEGLRPHHIQSYGNPVEQTWQKVYQAYQEACDRAGLVDFAELLLRAHELWLNKPHILQHYRERFTNILVDEFQDTNNIQYAWIRLLAGDTGKVMIVGDDDQSIYGWRGAQVENIQRFLNDFPGAETIRLEQNYRSTSNILSAANALIENNNGRLGKKLWTDGADGEPISLYCAFNELDEARFVVNRIKTWQDNGGALAECAILYRSNAQSRVLEEALLQASMPYRIYGGMRFFERQEIKDALSYLRLIANRNDDAAFERVVNTPTRGIGDRTLDVVRQTSRDRQLTLWQACRELLQEKALAGRAASALQRFMELIDALAQETADMPLHVQTDRVIKDSGLRTMYEQEKGEKGQTRIENLEELVTATRQFSYNEEDEDLMPLQAFLSHAALEAGEGQADTWQDAVQLMTLHSAKGLEFPQVFIVGMEEGMFPSQMSLDEGGRLEEERRLAYVGVTRAMQKLTLTYAETRRLYGKEVYHRPSRFIGELPEECVEEVRLRATVSRPVSHQRMGTPMVENDSGYKLGQRVRHAKFGEGTIVNMEGSGEHSRLQVAFQGQGIKWLVAAYARLESV

SEQ ID NO: 179 - protein, 128 aa, Escherichia coli
AREMKERVGQTLGRKEARGLMISTFHTLGLDIIKREYAALGMKANFSLFDDTDQLALLKELTEGLIEDDKVLLQQLISTISNWKNDLKTPSQAAASAIGERDRIFAHCYGLYDAHLKACNVLDFDDLI

SEQ ID NO: 180 - protein, 119 aa, Buchnera aphidicola
AHEIKVRLAKHLNLLQIKKMIISTFHSLGLEIIKKEINTLKFNSNFSLFDERDQMMLLKKICSKSIKNDTKLLKKLVFMISFWKNKFLTPLQVQLSAQSNLEKDFAFFYKQYTFHLRKS

SEQ ID NO: 181 - protein, 119 aa, Buchnera aphidicola
AYEMRIRLSKYLNIPEIKKIIISTFHSLGLEIIKKEIDALELNNNFTLLDEKDQILLLKKICKKEIKNNIQLLKKLNFMISYWKNKFLTPLQVQLLAKSSQEKDFAYVYEQYTNYLYKA

SEQ ID NO: 182 - protein, 119 aa, Haemophilus influenza
AREMKERVAHSIGKEQSKGLLVSTFHTLGFDILKREYKALGFKSNMTLFDEHDQFALLKELTADVLKEDKDLLRELISVISNWKNDLISPKQAFALARDAKYQTFAKCYERYATQIRTY

SEQ ID NO: 183 - protein, 119 aa, Salmonella enterica
  Salmonella typhimurium
AREMKERVGQTLGRKEARGLMISTFHTLGLDIIKREYAALGMKSNFSLFDDTDQVALLKELTEGLIEDDKVLLQQLISTISNWKNDLKTPAQAAAGAKGERDRIFAHCYGLYDAHMKAC

SEQ ID NO: 184 - protein, 119 aa, Trichuris trichiura
AREMKERVGQTLGRKEARGLMISTFHTLGLDIIKREYAALGMKANFSLFDDTDQLALLKELTEGLIEDDKVLLQQLISTISNWKNDLKTPSQAAASAIGERDRIFAHCYGLYDAHLKAC

SEQ ID NO: 185 - protein, 119 aa, Cedecea davisae
AREMKERVSQTLGRKEARGLMISTFHTLGLEIIKREYAALGMKSNFSLFDDTDQTALLKELTEGLLENDKVLLQQLISTISNWKNSLLTPAQAAAQAKGERDRIFAHCYGLYDTHLKSC

SEQ ID NO: 186 - protein, 119 aa, Kosakonia radicincitans
AREMKERVAQTLGRKEARGLMISTFHTLGLTIIKREFAALGMKSNFSLFDDTDQVALLKELTEGLIDDDKAVLQQLISTISNWKNDLLTPPQAAAQAKGERDRIFAHCYGLYDSHMKSC

SEQ ID NO: 187 - protein, 119 aa, Cronobacter muytjensii
AREMKERVAQTLGRKEARGLMISTFHTLGLEIIKREYAALGMKSNFSLFDDTDQMALIKELTEGLIENDKVLLQQLISTISNWKNDLLSPPQAAARAIGERDRIFAHCYSLYDAHLKAC

SEQ ID NO: 188 - protein, 119 aa, Klebsiella pneumonia
AREMKERVGQTLGRKEARGLMISTFHTLGLDIIKREYAALGMKSNFSLFDDTDQVALLKELTEGLIEDDKVVLQQLISTISNWKNDLKTPAQAAAGAKGERDRIFAHCYGLYDAHMKAC

SEQ ID NO: 189 - protein, 119 aa, Escherichia vulneris
AREMKERVGQTLGRKEARGLMISTFHTLGLDIIKREYAALGMKSNFSLFDDTDQVALLKDLTEGLIEDEKTILQQLISTISNWKNDLMTPAQAAAQARGERDRIFAHCYSLYDAHMKAC

SEQ ID NO: 190 - protein, 119 aa, Citrobacter amalonaticus
AREMKERVGQTLGRKEARGLMISTFHTLGLEVIKREYAALGMKSNFSLFDDTDQVALLKDLTEGLIEDDKVILQQLISTISNWKNDLKTPAQAAAGAKGERDRIFAHCYGLYDAHMKAC

SEQ ID NO: 191 - protein, 119 aa, Salmonella enterica; identical to SEQ ID NO: 183
  Salmonella derby

SEQ ID NO: 192 - protein, 119 aa, Raoultella planticola
AREMKERVGQTLGRKEARGLMISTFHTLGLDIIKREYAALGMKSNFSLFDDTDQVALLKELTEGLIDDDKVVLQQLISTISNWKNDLQTPAQAAAGAKGERERIFAHCYGLYDGHMKAC

SEQ ID NO: 193 - protein, 119 aa, Shigella boydii
AREMKERVGQTLGRKEARGLMISTFHTLGLDIIKREYAALGMKVNFSLFDDTDQLALLKELTEGLIEDDKVLLQQLISTISNWKNDLKTPSQAAASAIGERDRIFAHCYGLYDAHLKAC

SEQ ID NO: 194 - protein, 119 aa, Buttiauxella agrestis
AREMKERVAQTLGRKEARGLLISTFHTLGLEIIKREYAALGMKSNFSLFDDTDQTALLKDLTEGLLEDDKTLLQQLISTISNWKNDLMSPSQAAAQAKGERDRIFAHCYGLYDTHLKSC

SEQ ID NO: 195 - protein, 119 aa, Leclercia adecarboxylata
AREMKERVGQTLGRKEARGLMISTFHTLGLDIIKREYAALGMKSNFSLFDDTDQVALLKELTEGLIEDDKTVLQQLISTISNWKNDLMNPEQAAASAKGERDRIFAHCYGLYNDHLKAC

SEQ ID NO: 196 - protein, 119 aa, Citrobacter youngae
AREMKERVAQTLGRKEARGLMISTFHTLGLDVIKREYAALGMKSNFSLFDDTDQVALLKELTEGLIEDDKLILQQLISTISNWKNDLMTPAQAAASAKGERDRIFAHCYGLYDAHMKAC

SEQ ID NO: 197 - protein, 119 aa, Salmonella enterica; identical to SEQ ID NO: 183
  Salmonella senftenberg

SEQ ID NO: 198 - protein, 119 aa, Citrobacter freundii
AREMKERMAQTLGRKEARGLMISTFHTLGLDIIKREYAALGMKSNFSLFDDTDQVALLKELTEGLIEDDKLILQQLISTISNWKNDLMTPAQAAASAKGERDRIFAHCYGLYDAHMKAC

SEQ ID NO: 199 - protein, 119 aa, Cronobacter sp.
AREMKERVAQTLGRKEARGLMISTFHTLGLEIIKREYNALGMKANFSLFDDTDQMALIKELTEGLVENDKSLLQQLISTISNWKNDLLNPLQAAAQAKGERDRIFAHCYGLYDAHLKAC

SEQ ID NO: 200 - protein, 119 aa, Enterobacter hormaechei
AREMKERVGQTLGRKEARGLMISTFHTLGLDIIKREYAALGMKSNFSLFDDTDQVALLKELTEGLIEDDKVLLQQLISTISNWKNDLMTPAQAAASAKGERDRIFAHCYGLYDAHMKAC

SEQ ID NO: 201 - protein, 119 aa, Enterobacter cancerogenus
AREMKERVGQTLGRKEARGLMISTFHTLGLDIIKREYAALGMKSNFSLFDDTDQVALLKELTEGLIEDDKTVLQQLISTISNWKNDLMTPSQAAAIAKGERDRIFAHCYGLYDAHMKAC

SEQ ID NO: 202 - protein, 119 aa, Trabulsiella guamensis
AREMKERVAQTLGRKEARGLMISTFHTLGLEIIKREFAALGMKSNFSLFDDTDQVALLKELTEGLIDDDKTLLQQLISTISNWKNDLLTPAQAAAQAKGERDRIFAHCYGLYDAHMKAC

SEQ ID NO: 203 - protein, 119 aa, Raoultella ornithinolytica; identical to SEQ ID NO: 192

SEQ ID NO: 204 - protein, 119 aa, Salmonella enterica; identical to SEQ ID NO: 183
  Salmonella typhi

SEQ ID NO: 205 - protein, 119 aa, Shigella flexneri
AREMKERVGQTLGRKEAHGLMISTFHTLGLDIIKREYAALGMKANFSLFDDTDQLALLKELTEGLIEDDKVLLQQLISTISNWKNDLKTPSQAAASAIGERDRIFAHCYGLYDAHLKAC

SEQ ID NO: 206 - protein, 119 aa, Klebsiella michiganensis
AREMKERVSQTLGRKEARGLMISTFHTLGLEIIKREYAALGMKSNFSLFDDTDQTALLKELTEGLLENDKVLLQQLISTISNWKNGLLSPAQAAAQAKGERDRIFAHCYGLYDTHLKSC

SEQ ID NO: 207 - protein, 119 aa, Enterobacter aerogenes; identical to SEQ ID NO: 188

SEQ ID NO: 208 - protein, 119 aa, Salmonella enterica; identical to SEQ ID NO: 183
  Salmonella paratyphi

SEQ ID NO: 209 - protein, 119 aa, Klebsiella oxytoca
AREMKERVGQTLGRKEARGLMISTFHTLGLDIIKREYAALGMKSNFSLFDDTDQVALLKELTEGLIEDDKVVLQQLISTISNWKNDLQTPAQAAAGAKGERDRIFAHCYGLYDAHMKAC

SEQ ID NO: 210 - protein, 119 aa, Citrobacter freundii
AREMKERVAQTLGRKEARGLMISTFHTLGLDIIKREYAALGMKSNFSLFDDTDQVALLKELTEGLIEDDKLILQQLISTISNWKNDLMTPAQAAASAKGERDRIFAHCYGLYDAHMKAC

SEQ ID NO: 211 - protein, 119 aa, Enterobacter cloacae; identical to SEQ ID NO: 200

SEQ ID NO: 212 - protein, 119 aa, Citrobacter rodentium
AREMKERVGQTLGRKEARGLMISTFHTLGLEIIKREYAALGMKSNFSLFDDTDQLALLKELTEGLLEEDKVLLQQLISTISNWKNDLQTPAQAAAGAKGERDRIFAHCYGLYDAHLKAC

SEQ ID NO: 213 - protein, 119 aa, Shigella dysenteriae
AREMKERVGQTLGRKEARGLMISTFHTLGLDIIKREYAALGMKANFSLFDDTDQLALLKELTEGLIEDDKVLLQQLISTISNWKNDLKTPAQAAAEAKGERDRIFAHCYGLYDAHLKAC

SEQ ID NO: 214 - protein, 119 aa, Kosakonia sacchari
AREMKERVAQTLGRKEARGLMISTFHTLGLNIIKREFAALGMKSNFSLFDDTDQVALLKDLTEGLIDDDKVVLQQLISTISNWKNDLLTPPQAAARANGERDRIFAHCYGLYDAHMKAC

SEQ ID NO: 215 - protein, 119 aa, Shimwellia blattae
AREMKERVAQTLGRKEARGLMISTFHTLGLEIIKREYAALGMKSNFSLFDDTDQLALIKDLTEGLLENDKVIYQQLISTISNWKNDLMGPDQAAAMARGERDRIFAHCYRLYYDHLKAC

SEQ ID NO: 216 - protein, 119 aa, Salmonella enterica; identical to SEQ ID NO: 183
  Salmonella agona

SEQ ID NO: 217 - protein, 119 aa, Citrobacter amalonaticus; identical to SEQ ID NO: 196

SEQ ID NO: 218 - protein, 119 aa, Yokenella regensburgei
AREMKERVAQTLGRKEARGLMISTFHTLGLDIIKREYAALGMKSNFSLFDDTDQVALLKELTEGLLEDDKVLLQQLISTISNWKNDLMTPAQAAAQAKGERDRIFAHCYSLYDAHMKAC

SEQ ID NO: 219 - protein, 119 aa, Citrobacter werkmanii; identical to SEQ ID NO: 196

SEQ ID NO: 220 - protein, 119 aa, Salmonella enterica
  Salmonella arizonae
AREMKERVGQTLGRKEARGLMISTFHTLGLDIIKREYAALGMKSNFSLFDDTDQVALLKELTEGLIDDDKVVLQQLISTISNWKNDLKTPAQAAAGAKGERDRIFAHCYGLYDAHMKAC

SEQ ID NO: 221 - protein, 119 aa, Shigella sonnei; identical to SEQ ID NO: 184

SEQ ID NO: 222 - protein, 119 aa, Klebsiella variicola; identical to SEQ ID NO: 188

SEQ ID NO: 223 - protein, 119 aa, Salmonella enterica
  Salmonella choleraesuis
AREMKERVGQTLGRKEARGLMISTFHTLGLDIIKREYAALGMKSNFSLFDDSDQVALLKELTEGLIEDDKVLLQQLISTISNWKNDLKTPAQAAAGAKGERDRIFAHCYGLYDAHMKAC

SEQ ID NO: 224 - protein, 119 aa, Salmonella enterica; identical to SEQ ID NO: 183
  Salmonella gallinarum

SEQ ID NO: 225 - protein, 119 aa, Cedecea neteri; identical to SEQ ID NO: 206

SEQ ID NO: 226 - protein, 119 aa, Salmonella enterica; identical to SEQ ID NO: 183
  Salmonella Newport

SEQ ID NO: 227 - protein, 119 aa, Siccibacter turicensis
AREMKERVAQTMGRKEARGLMISTFHTLGLEIIKREYVALGMKSNFSLFDDTDQMALIKELTEGLVENDKVLLQQLISTISNWKNDLLSPPQAAARAIGERERIFAHCYSLYDAHLKAC

SEQ ID NO: 228 - protein, 119 aa, Escherichia fergusonii
AREMKERVGQTLGRKEARGLMISTFHTLGLDIIKREYAALGMKANFSLFDDTDQLALLKELTEGLIEDDKVLLQQLISTISNWKNDLKTPAQAAAEAKGERDRIFAHCYGLYDSHLKAC

SEQ ID NO: 229 - protein, 119 aa, Salmonella enterica; identical to SEQ ID NO: 188
  Salmonella enteritidis

SEQ ID NO: 230 - protein, 119 aa, Enterobacter asburiae
AREMKERVGQTLGRKEARGLMISTFHTLGLDIIKREYAALGMKSNFSLFDDTDQVALLKELTEGLIEDDKVLLQQLISTISNWKNDLMTPAQAAASAKGERDRIFAHCYSLYDAHMKAC

SEQ ID NO: 231 - protein, 119 aa, Salmonella enterica; identical to SEQ ID NO: 183

SEQ ID NO: 232 - protein, 119 aa, Cronobacter sakazakii
AREMKERVAQTLGRKEARGLMISTFHTLGLEIIKREYAALGMKSNFSLFDDTDQMALIKELTEGLVENDKVLLQQLISTISNWKNDLLSPPQAAARAIGERERIFAHCYSLYDAHLKAC

SEQ ID NO: 233 - protein, 119 aa, Enterobacteriaceae bacterium
AREMKERVAQTLGRKEARGLMISTFHTLGLDIIKREYAALGMKSNFSLFDDTDQVALLKDLTEGLIEDDKVQLQQLISTISNWKNDLKSPAQAAAGAKGERDRIFAHCYGLYDAHMKAC

SEQ ID NO: 234 - protein, 119 aa, Salmonella bongori
AREMKERVGQTLGRKEARGLMISTFHTLGLEIIKREYAALGMKSNFSLFDDTDQTALLKELTEGLIEDDKILLQQLISTISNWKNDLKTPAQAAASAIGERDRIFAHCYGLYDAHMKAC

SEQ ID NO: 235 - protein, 119 aa, Citrobacter koseri
AREMKERVGQTLGRKEARGLMISTFHTLGLDIIKREYAALGMKSNFSLFDDTDQVALLKELTDGLIEDDKVILQQLISTISNWKNDLMTPAQAAASAKGERDRIFAHCYGLYDAHLKAC

SEQ ID NO: 236 - protein, 179 aa, Escherichia coli
EKFLMQNRIPYKISGGTSFFSRPEIKDLLAYLRVLTNPDDDSAFLRIVNTPKREIGPATLKKLGEWAMTRNKSMFTASFDMGLSQTLSGRGYEALTRFTHWLAEIQRLAEREPIAAVRDLIHGMDYESWLYETSPSPKAAEMRMKNVNQLFSWMTEMLEGSELDEPMTLTQVVTRFTLR

SEQ ID NO: 237 - protein, 179 aa, Buchnera aphidicola
EKTFLKKNIPYDISTNSSFFSRPEIKDLLSYLRLIVNPDDNHAFIRILNIPHRQIGLTTLNKLEELASKKNKSLFQISNDIEIKKILRERTVKKIKDFIYWIKKIIKLSLLKEDIILDKIINDIKYELWLTKILKEPKKIKTSINNIYTLSNWLKEMLRGNEFEKPMNLLQIVKKMTLR

SEQ ID NO: 238 - protein, 179 aa, Buchnera aphidicola
EKALIKENIPYNISEKSSFFSRPEIKDLLSYLRVVINRDDNHAFMRIVNIPSRQIGKTTLKKLEEWANKKHVSLFQASNNIEIKKFLNENTIKKIKNFISKIEKFTAWSCLKPSNIIDDIVDDLEYEKWLSKFLKDPNKIKNSINNVHTLSQWFKNMIKGDDFEKPMTLFQIVTRMTIR

SEQ ID NO: 239 - protein, 180 aa, Haemophilus influenza
EKVLMQNRIPYKISGGTSFFSRAEIKDMMAYLRLVVNQDDDAAFLRIVNTPKREIGTATLQKLGELAQEKHISLFEAIFEFELIQRITPKAYDSLQKFGRWIVELNDEIQRSEPERAVRSMLSAIHYEEYLYEYATSPKAAEMQSKNVATLFDWVADMLKGDETNEPMNLNQVVTRLTLR

SEQ ID NO: 240 - protein, 179 aa, Salmonella enterica
  Salmonella typhimurium
EKFLMQNRIPYKISGGTSFFSRPEIKDLLAYLRVLTNPDDDSAFLRIVNTPKREIGPATLQKLGEWAMTRNKSLFTASFDMGLSQKLTGRGYDSLTRFTHWLGEIQRLAEREPVAAVRDLIHGIDYESWLYETSPSPKAAEMRMKNVNQLFSWMTEMLEGNELDEPMTLTQVVTRFTLR

SEQ ID NO: 241 - protein, 179 aa, Trichuris trichiura; identical to SEQ ID NO: 236

SEQ ID NO: 242 - protein, 179 aa, Cedecea davisae
EKMLMQNRIPYHISGGTSFFSRPEIKDLLAYLRVLTNPDDDSAFLRIVNTPKREIGPATLQKLGEWATQRNKSLLTASFDMGLSQTLSGRGLESLQRFTHWLREVATLAEREPVAAVRDLIHGIDYESWLYETSPSPKAAEMRMKNVNQLFSWMTEMLEASDLDEPMTLVQVVTRFTLR

SEQ ID NO: 243 - protein, 179 aa, Kosakonia radicincitans
EKFLMQNRIPYKISGGTSFFSRPEIKDLLAYLRVLTNTEDDSAFLRIVNTPKREIGSATLQKLGEWAMLRNKSLFAASFDVGLNQTLTGRGYESLTRFTQWLGDVQQLSEREPIAAVRDLIHGIDYESWLFETSPSPKAAEMRMKNVNTLFGWMTEMLEGSELDEPMTLAEVVTRFTLR

SEQ ID NO: 244 - protein, 179 aa, Cronobacter muytjensii
EKMLMQNRIPYRISGGTSFFSRPEIKDLLAYLRVLTNPDDDSAFLRIVNTPKREIGPATLQKLGEWATQRNKSLFTASFDMGLSQSLTGRGYESLTRFTQWLQEVAVLSEREPVAAVRDLIRGIDYEAWLFETSPSPKAAEMRMKNVNQLFSWMTEMLEGTDLDEPMTLTQVVTRFTLR

SEQ ID NO: 245 - protein, 179 aa, Klebsiella pneumonia
EKMLMQNRIPYKISGGTSFFSRPEIKDLLAYLRVLTNPDDDSAFLRIVNTPKREIGPATLQKLGEWAMGRNKGLFTASFDMGLSQTLTGRGYESLTRFTHWLREIQQLAEREPVNAVRDLIRGIDYESWLYETSPSPKAAEMRMKNVNQLFTWMTEMLEGSEIDEPMTLTQVVTRFTLR

SEQ ID NO: 246 - protein, 179 aa, Escherichia vulneris
EKFLMQNRIPYRISGGTSFFSRPEIKDLLAYLRVLTNPDDDSAFLRIVNTPKREIGPATLQKLGEWANSRNKGLFAASFDMGLTQTLSGRGYESLTRFTHWLSEVQRLSEREPIAAVRDLIHGIDYESWLFETSPSPKAAEMRMKNVNTLFSWMTEMLEGSEIDEPMTLTQVVTRFTLR

SEQ ID NO: 247 - protein, 179 aa, Citrobacter amalonaticus
EKFLMQNRIPYKISGGTSFFSRPEIKDLLAYLRVLTNPDDDSAFLRIVNTPKREIGPATLQKLGEWAMTRNKSLFTASFDLGLSQTLTGRGYDSLTRFTHWLGEVQRLAEREPIAAVRDLIHGIDYESWLYETSPSPKAAEMRMKNVNQLFSWMTEMLEGSELDEPMTLTQVVSRFTLR

SEQ ID NO: 248 - protein, 179 aa, Salmonella enterica
  Salmonella derby
EKFLMQNRIPYKISGGTSFFSRLEIKDLLAYLRVLTNPDDDSAFLRIVNTPKREIGPATLQKLGEWAMTRNKSLFTASFDMGLSQKLTGRGYDSLTRFTHWLGEIQRLAEREPVAAVRDLIHGIDYESWLYETSPSPKAAEMRMKNVNQLFSWMTEMLEGNELDEPMTLTQVVTRFTLR

SEQ ID NO: 249 - protein, 179 aa, Raoultella planticola
EKMLMQNRIPYKISGGTSFFSRPEIKDLLAYLRVLTNPDDDSAFLRIVNTPKREIGPATLQKLGEWAMTRNKSLFTASFDMGLNQTLTGRGYDALTGFTQWLADIQRLAEREPVAAVRDLIRGVDYESWLYETSPSPKAAEMRMKNVNQLFSWMTEMLEGSDIDEPMTLTQVVTRFTLR

SEQ ID NO: 250 - protein, 179 aa, Shigella boydii
EKFLMQNRIPYKISGGTSFFSRPEIKDLLAYLRVLTNPDDDSAFLRIVNTPKREIGPATLKKLGEWAMTRNKSMFTASFDMGLSQTLSGRGYEALTRFTHWLAEIQRLAEREPIAAVRDLIHGMDYEFWLYETSPSPKAAEMRMKNVNQLFSWMTEMLEGSELDEPMTLTQVVTRFTLR

SEQ ID NO: 251 - protein, 179 aa, Buttiauxella agrestis
EKMLMQNRIPYRISGGTSFFSRPEIKDLLAYLRVLTNPDDDSAFMRIVNTPKREIGSATLQKLGAWAMQRNKGLFLSSFDMGLSQTLSGRGLESLQRFTHWLREVATLAEREPIAAVRDLIHGIDYESWLYETSPSQKAAEMRMKNVNTLFSWMTEMLEGSEIDEPMTLTQVVTRFTLR

SEQ ID NO: 252 - protein, 179 aa, Leclercia adecarboxylata
EKMLMQNRIPYKISGGTSFFSRPEIKDLLAYLRVLTNPDDDSAFLRIVNTPKREIGPATLQKLGEWAMTRNKSLLTASFDMGLSHTLTGRGYESLTRFTHWLREIQQLSEREPIAAVRDLIRGIDYESWLYETSASPKAAEMRMKNVNQLFSWMTEMLEGSDIDEPMTLTQVVTRFTLR

SEQ ID NO: 253 - protein, 179 aa, Citrobacter youngae
EKFLMQNRIPYKISGGTSFFSRPEIKDLLAYLRVLSNPDDDSAFLRIVNTPKREIGSATLQKLGEWAMTRNKSLFTASFDMGLSQTLTGRGYDSLTRFTHWLGEIQRLAEREPVAAVRDLIHGIDYESWLYETSPSPKAAEMRMKNVNTLFGWMTEMLEGSELEEPMTLTQVVTRFTLR

SEQ ID NO: 254 - protein, 179 aa, Salmonella enterica; identical to SEQ ID NO: 240
  Salmonella senftenberg

SEQ ID NO: 255 - protein, 179 aa, Citrobacter freundii
EKFLMQNRIPYKISGGTSFFSRPEIKDLLAYLRVLSNPDDDSAFLRIVNTPKREIGPATLQKLGEWAMTRNKSLFTASFDMGLSQTLTGRGYDSLTRFTHWLGEIQRLAEREPVAAVRDLIHGIDYESWLYETSPSPKAAEMRMKNVNTLFSWMTEMLEGSELEEPMTLTQVVTRFTLR

SEQ ID NO: 256 - protein, 179 aa, Cronobacter sp.
EKLLMQNRIPYRISGGTSFFSRPEIKDLLAYLRVLTNPDDDSAFLRIVNTPKREIGPATLQKLGEWAMSRNKSLFTASFDMGLSQTLTGRGYESLTRFTHWLGEVARLSEREPVAAVRDLIHGIDYEAWLYETSPSQKAAEMRMKNVNQLFSWMTEMLEGTELDEPMTLTQVVTRFTLR

SEQ ID NO: 257 - protein, 179 aa, Enterobacter hormaechei
EKMLMQNRIPYKISGGTSFFSRPEIKDLLAYLRVLTNPDDDSAFLRIVNTPKREIGSATLQKLGEWAMTRNKSLFTASFDMGLSQTLTGRGYDALTRFTHWLGEVQRLAEREPVAAVRDLIHGIDYESWLYETSASPKAAEMRMKNVNQLFSWMTEMLEGSEIDEPMTLTQVVTRFTLR

SEQ ID NO: 258 - protein, 179 aa, Enterobacter cancerogenus
EKMLMQNRIPYKISGGTSFFSRPEIKDLLAYLRVLTNPDDDSAFLRIVNTPKREIGPATLQKLGEWAMTRSKSMFTASFDMGLSQTLTGRGYDNLTRFTHWLGEVQRLAEREPVAAVRDLIHGIDYESWLYETSASPKAAEMRMKNVNQLFSWMTEMLEGSEIDEPMTLTQVVTRFTLR

SEQ ID NO: 259 - protein, 179 aa, Trabulsiella guamensis
EKMLMQNRIPYKISGGTSFFSRPEIKDLLAYLRVLTNPDDDSAFLRIVNTPKREIGPATLQKLGEWASTRNKSLFTASFDVGLTQTLSGRGYDALTRFTHWLGEIQRLSEREPVAAVRDLIHGIDYESWLFETSPSPKAAEMRMKNVNQLFSWMTEMLEGSELDEPMTLTQVVTRFTLR

SEQ ID NO: 260 - protein, 179 aa, Raoultella ornithinolytica; identical to SEQ ID NO: 249

SEQ ID NO: 261 - protein, 179 aa, Salmonella enterica; identical to SEQ ID NO: 240
  Salmonella typhi

SEQ ID NO: 262 - protein, 179 aa, Shigella flexneri
EKFLMQNRIPYKISGGTSFFSRPEIKDLLAYLRVLTNPDDDSAFLRIVNTPKREIGPATLKKLGEWAMTRNKSMFTASFDMGLSQTLSGRGYEALTRFTHWLAEIQRLAEREPIAAVRDLIHGMDYESWLYETSPSTKAAEMRMKNVNQLFSWMTEMLEGSELDEPMTLTQVVTRFTLR

SEQ ID NO: 263 - protein, 179 aa, Klebsiella michiganensis
EKMLMQNRIPYRISGGTSFFSRPEIKDLLAYLRVLTNPDDDSAFLRIVNTPKREIGPATLQKLGEWAMQRNKGLFTASFDMGLSQTLSGRGLDALQRFTHWLRDVATLAEREPVAAVRDLIHGIDYESWLYETSPSPKAAEMRMKNVNQLFSWMTEMLEGSDLDEPMTLTQVVTRFTLR

SEQ ID NO: 264 - protein, 179 aa, Enterobacter aerogenes
EKMLMQNRIPYKISGGTSFFSRPEIKDLLAYLRVLTNPDDDSAFLRIVNTPKREIGPATLQKLGEWAMSRNKGLFTASFDMGLSQTLTGRGYESLTRFTHWLREIQQLAEREPVNAVRDLIRGIDYESWLYETSPSPKAAEMRMKNVNQLFTWMTEMLEGSEIDEPMTLTQVVTRFTLR

SEQ ID NO: 265 - protein, 179 aa, Salmonella enterica
  Salmonella paratyphi
EKFLMQNRIPYKISGGTSFFSRPEIKDLLAYLRVLTNPDDDSAFLRIVNTPKREIGPATLQKLGEWAMTRNKSLFTASFDMGLSQKLTGRGYDSLTRFTHWLGEIQRLAEREPVAAVRDLIHGIDYESWLYETSPSPKAAEMRMKNVNQLFSWMTEMLEGNELDEPMTLTLVVTRFTLR

SEQ ID NO: 266 - protein, 179 aa, Klebsiella oxytoca
EKMLMQNRIPYKISGGTSFFSRPEIKDLLAYLRVLTNPDDDSAFMRIVNTPKREIGSATLKKLGEWAMGRNKSMFTASFDMGLTQTLNGRGYESLTRFTHWLREIQQLSEREPIAAVRDLIRGVDYESWLYETSPSPKAAEMRMKNVNTLFTWMTEMLEGSEIDEPMTLTQVVTRFTLR

SEQ ID NO: 267 - protein, 179 aa, Citrobacter freundii; identical to SEQ ID NO: 255

SEQ ID NO: 268 - protein, 179 aa, Enterobacter cloacae
EKMLMQNRIPYKISGGTSFFSRPEIKDLLAYLRVLTNPDDDSAFLRIVNTPKREIGPATLQKLGEWAMTRNKSLFTASFDMGLSQTLTGRGYDSLTRFTHWLGEVQRLAEREPVAAVRDLIHGIDYESWLYETSASPKAAEMRMKNVNQLFSWMTEMLEGSEIDEPMTLTQVVTRFTLR

SEQ ID NO: 269 - protein, 179 aa, Citrobacter rodentium
EKFLMQNRIPYKISGGTSFFSRPEIKDLLAYLRVLTNPDDDSAFLRIVNTPKREIGPATLQKLGEWAMTRNKSLFTASFDLGLAQTLTGRGYESLTRFTHWLGEVQRLAEREPVAAVRDLIHGIDYESWLYETSPSPKAAEMRMKNVNQLFSWMTEMLEGSELDEPMTLTQVVTRFTLR

SEQ ID NO: 270 - protein, 179 aa, Shigella dysenteriae; identical to SEQ ID NO: 236

SEQ ID NO: 271 - protein, 179 aa, Kosakonia sacchari
EKFLMQNRIPYKISGGTSFFSRPEIKDLLAYLRVLTNTDDDSAFLRIVNTPKREIGSATLQKLGEWAMLRNKSLFAASFDVGLNQTLTGRGYDALTRFTHWLGEVQRLSEREPIAAVRDLIHGIDYESWLFETSASPKAAEMRMKNVNTLFGWMTEMLEGSELDEPMTLAEVVTRFTLR

SEQ ID NO: 272 - protein, 179 aa, Shimwellia blattae
EKMLMQNRIPYRISGGTSFFSRPEIKDLLAYLRVLTNPDDDSAFLRIVNTPRREIGPATLQKLGEWALQRNKSMFTASFDLGLSQTLTGRGYEALTRFTHWLGEVARLSEKEPVAAVRDLIHGIDYESWLFETSPSPKAAEMRMKNVNQLFTWMTEMLEGSDLEEPMTLTQVVTRFTLR

SEQ ID NO: 273 - protein, 179 aa, Salmonella enterica; identical to SEQ ID NO: 240
  Salmonella agona

SEQ ID NO: 274 - protein, 179 aa, Citrobacter amalonaticus
EKFLMQNRIPYKISGGTSFFSRPEIKDLLAYLRVLSNPDDDSAFLRIVNTPKREIGPATLQKLGEWAMTRNKSLFTASFDMGLSQTLTGRGYDSLTRFTHWLGDIQRLAEREPVAAVRDLIHGIDYESWLYETSPSPKAAEMRMKNVNTLFSWMTEMLEGSELEEPMTLTQVVTRFTLR

SEQ ID NO: 275 - protein, 179 aa, Yokenella regensburgei
EKMLMQNRIPYKISGGTSFFSRPEIKDLLAYLRVLTNPDDDSAFLRIVNTPKREIGPATLQKLGEWAMTRSKSMFTASFDMGLSHLLPGRGYESLTRFTHWLGEVQRLSEREPIAAVRDLIHGIDYESWLFETSPSPKAAEMRMKNVNQLFSWMTEMLEGSELEEPMTLTQVVTRFTLR

SEQ ID NO: 276 - protein, 179 aa, Citrobacter werkmanii; identical to SEQ ID NO: 255

SEQ ID NO: 277 - protein, 179 aa, Salmonella enterica
  Salmonella arizonae
EKFLMQNRIPYKISGGTSFFSRPEIKDLLAYLRVLTNPDDDSAFLRIVNTPKREIGSATLQKLGEWAMTRNKSLFTASFDMGLSQTLTGRGYDSLTRFTHWLGEIQRLAEREPIAAVRDLIHGIDYESWLYETSPSPKAAEMRMKNVNQLFSWMTEMLEGNELNEPMTLTQVVTRFTLR

SEQ ID NO: 278 - protein, 179 aa, Shigella sonnei; identical to SEQ ID NO: 236

SEQ ID NO: 279 - protein, 179 aa, Klebsiella variicola; identical to SEQ ID NO: 245

SEQ ID NO: 280 - protein, 179 aa, Salmonella enterica; identical to SEQ ID NO: 240
  Salmonella choleraesuis

SEQ ID NO: 281 - protein, 179 aa, Salmonella enterica; identical to SEQ ID NO: 240
  Salmonella gallinarum

SEQ ID NO: 282 - protein, 179 aa, Cedecea neteri
EKMLMQNRIPYRISGGTSFFSRPEIKDLLAYLRVLTNPDDDSAFLRIVNTPKREIGPATLQKLGEWAMQRNKGLFTASFDMGLSQTLSGRGLDSLQRFTHWLRDVATLAEREPVAAVRDLIHGIDYESWLYETSPSPKAAEMRMKNVNQLFSWMTEMLEGSDLDEPMTLTQVVTRFTLR

SEQ ID NO: 283 - protein, 179 aa, Salmonella enterica; identical to SEQ ID NO: 240
  Salmonella Newport

SEQ ID NO: 284 - protein, 179 aa, Siccibacter turicensis
EKMLMQNRIPYRISGGTSFFSRPEIKDLLAYLRVLTNPGDDSAFLRIVNTPKREIGPATLQKLGEWANQRNKSLFTASFDMGLAQTLSGRGYESLTRFTSWLQDVAVLSEREPVAAVRDLIRGIDYEAWLFETSPSPKAAEMRMKNVNQLFSWMTEMLEGTDLDEPMTLTQVVTRFTLR

SEQ ID NO: 285 - protein, 179 aa, Escherichia fergusonii; identical to SEQ ID NO: 236

SEQ ID NO: 286 - protein, 179 aa, Salmonella enterica; identical to SEQ ID NO: 240
  Salmonella enteritidis

SEQ ID NO: 287 - protein, 179 aa, Enterobacter asburiae; identical to SEQ ID NO: 268

SEQ ID NO: 288 - protein, 179 aa, Salmonella enterica; identical to SEQ ID NO: 240

SEQ ID NO: 289 - protein, 179 aa, Cronobacter sakazakii
EKMLMQNRIPYRISGGTSFFSRPEIKDLLAYLRVLTNPDDDSAFLRIVNTPKREIGPATLQKLGEWANQRNKSLFTASFDMGLAQTLTGRGYESLTRFTSWLQEVAVLSEREPVAAVRDLIRGIDYEAWLFETSPSPKAAEMRMKNVNQLFSWMTEMLEGTDLDEPMTLTQVVTRFTLR

SEQ ID NO: 290 - protein, 179 aa, Enterobacteriaceae bacterium
EKFLMQNRIPYKISGGTSFFSRPEIKDLLAYLRVLTNPDDDSAFLRIVNTPKREIGAATMQKLGEWAMTRNKSLFAASFDMGLTQTLTGRGYESLTRFTQWLAEVQRLSEREPIAAVRDLIHGIDYESWLFETSASPKAAEMRMKNVNTLFGWMTEMLEGSEIDEPMTLTQVVTRFTLR

SEQ ID NO: 291 - protein, 179 aa, Salmonella bongori
EKFLMQNRIPYKISGGTSFFSRPEIKDLLAYLRVLTNPDDDSAFLRIVNTPKREIGPATLQKLGEWAMTRSKSLFTASFDMGLSQTLTGRGYDALTRFTHWLAEIQRLAEREPVAAVRDLIHGIDYESWLYETSPSPKAAEMRMKNVNQLFGWMTEMLEGSDIDEPMTLTQVVTRFTLR

SEQ ID NO: 292 - protein, 179 aa, Citrobacter koseri
EKFLMQNRIPYKISGGTSFFSRPEIKDLLAYLRVLTNPDDDSAFLRIVNTPKREIGPATLQKLGEWAMTRNKSLFTASFDVGLNQTLTGRGYDSLTRFTHWLGEIQRLSEREPIAAVRDLIHGIDYESWLYETSPSPKAAEMRMKNVNQLFSWMTEMLEGNELDEPMTLTQVVTRFTLR

SEQ ID NO: 293 - protein, 58 aa, Deinococcus radiodurans
LAVTFTNKAAAEMRERAGHLVPGAGDLWMSTFHSAGVRILRTYGEHIGLRRGFVIYDD

SEQ ID NO: 294 - protein, 59 aa, Escherichia coli
MAVTFTNKAAAEMRHRIGQLMGTSQGGMWVGTFHGLAHRLLRAHHMDANLPQDFQILDS

SEQ ID NO: 295 - protein, 59 aa, Geobacillus stearothermophilus
LAITFTNKAAREMRERVQSLLGGAAEDVWISTFHSMCVRILRRDIDRIGINRNFSILDP

SEQ ID NO: 296 - protein, 60 aa, Escherichia coli
AAVTFTNKAAREMKERVGQTLGRKEARGLMISTFHTLGLDIIKREYAALGMKANFSLFDD

SEQ ID NO: 297 - protein, 60 aa, Deinococcus radiodurans
EAYRRYEVRKKGQNAIDFGDLITETVRLFKEVPGVLDKVQNKAKFIHVDEYQDTNRAQYE

SEQ ID NO: 298 - protein, 60 aa, Escherichia coli
KVYQAYQEACDRAGLVDFAELLLRAHELWLNKPHILQHYRERFTNILVDEFQDTNNIQYA

SEQ ID NO: 299 - protein, 60 aa, Geobacillus stearothermophilus
DVYQEYQQRLLRNHSLDFDDLIMTTIQLFDRVPDVLHYYQYKFQYIHIDEYQDTNRAQYT

SEQ ID NO: 300 - protein, 60 aa, Escherichia coli
HCYGLYDAHLKACNVLDFDDLILLPTLLLQRNEEVRKRWQNKIRYLLVDEYQDTNTSQYE

SEQ ID NO: 301 - protein, 235 aa, Deinococcus radiodurans
AILYRTNAQSRVIEESLRRVQIPARIVGGVGFYDRREIRDILAYARLALNPADDVALRRIIGRPRRGIGDTALQKLMEWARTHHTSVLTACANAAEQNILDRGAHKATEFAGLMEAMSEAADNYEPAAFLRFVMETSGYLDLLRQEGQEGQVRLENLEELVSAAEEWSQDEANVGGSIADFLDDAALLSSVDDMRTKAENKGAPEDAVTLMTLHNAKGLEFPVVFIVGVEQGLLP

SEQ ID NO: 302 - protein, 231 aa, Escherichia coli
AILYRSNAQSRVLEEALLQASMPYRIYGGMRFFERQEIKDALSYLRLIANRNDDAAFERVVNTPTRGIGDRTLDVVRQTSRDRQLTLWQACRELLQEKALAGRAASALQRFMELIDALAQETADMPLHVQTDRVIKDSGLRTMYEQEKGEKGQTRIENLEELVTATRQFSYNEEDEDLMPLQAFLSHAALEAGEGQADTWQDAVQLMTLHSAKGLEFPQVFIVGMEEGMFP

SEQ ID NO: 303 - protein, 232 aa, Geobacillus stearothermophilus
AVLYRTNAQSRVMEEMLLKANIPYQIVGGLKFYDRKEIKDILAYLRVIANPDDDLSLLRIINVPKRGIGASTIDKLVRYAADHELSLFEALGELEMIGLGAKAAGALAAFRSQLEQWTQLQEYVSVTELVEEVLDKSGYREMLKAERTIEAQSRLENLDEFLSVTKHFENVSDDKSLIAFLTDLALISDLDELDGTEQAAEGDAVMLMTLHAAKGLEFPVVFLIGMEEGIFP

SEQ ID NO: 304 - protein, 234 aa, Escherichia coli
AILYRGNHQSRVFEKFLMQNRIPYKISGGTSFFSRPEIKDLLAYLRVLTNPDDDSAFLRIVNTPKREIGPATLKKLGEWAMTRNKSMFTASFDMGLSQTLSGRGYEALTRFTHWLAEIQRLAEREPIAAVRDLIHGMDYESWLYETSPSPKAAEMRMKNVNQLFSWMTEMLEGSELDEPMTLTQVVTRFTLRDMMERGESEEELDQVQLMTLHASKGLEFPYVYMVGMEEGFLP

SEQ ID NO: 305 - DNA, 45 bp, Artificial Sequence
  Description of Artificial Sequence: Synthetic oligonucleotide
ttttttttttttttttttttttttttttttttttttttttttttt

What is claimed is:

1. A modified helicase comprising a first subdomain comprising a 1A or 1B subdomain having a first amino acid and a second subdomain comprising a 2B subdomain having a second amino acid,
    wherein said first amino acid is less than about 20 Å from said second amino acid when the helicase is in an active conformation,
    wherein the first amino acid corresponds to any one of positions 84-116 or 178-196 of the helicase amino acid sequence, relative to SEQ ID NO:32;
    wherein the second amino acid corresponds to any one of positions 388-411, 422-444, and 518-540 of the helicase amino acid sequence, relative to SEQ ID NO:32;
    wherein a side chain of the first amino acid is covalently crosslinked to a side chain of the second amino acid with a linker to form an active, conformationally-constrained helicase;
    wherein the conformationally-constrained helicase comprises at least one degree of freedom less than a helicase that is not constrained as such;
    wherein said helicase is selected from the group consisting of a Rep helicase from *E. coli*, a UvrD helicase from *E. coli*, a PcrA helicase from *B. stearothermophilus*, or a homolog thereof; and
    wherein the conformationally-constrained helicase enhances an unwinding function of the helicase.

2. The modified helicase of claim 1, wherein said first subdomain and said second subdomain comprise no more than a total of two cysteine residues.

3. The modified helicase of claim 1, wherein the first amino acid is covalently crosslinked to the second amino acid by a chemical crosslinker.

4. A modified Rep helicase or homolog thereof comprising an amino acid at position 178 covalently crosslinked to an amino acid at position 400, relative to SEQ ID NO:32, to form an active, conformationally-constrained Rep helicase or homolog thereof.

5. A kit for performing helicase dependent amplification, comprising:
    the conformationally-constrained helicase of claim 1; and
    amplification reagents.

6. A modified *E. coli* Rep helicase or homolog thereof comprising:
    a first subdomain having a first amino acid, a second subdomain having a second amino acid, and an axis vector defined by the alpha carbon of ILE371 from which the vector originates and the alpha carbon of SER280 or the alpha carbon of ALA603, wherein theta is an angle of rotation of said first amino acid and said second amino acid around the axis vector, wherein a theta between said first amino acid and said second amino acid is between about 355 degrees and about 25 degrees when the helicase is in an active conformation, wherein a side chain of the first amino acid is covalently crosslinked to a side chain of the second amino acid with a linker to form an active, conformationally-constrained helicase;

wherein the conformationally-constrained helicase comprises at least one degree of freedom less than a helicase that is not constrained; and wherein the conformationally-constrained helicase enhances an unwinding function of the helicase.

7. The modified *E. coli* Rep helicase or homolog thereof of claim 6, wherein the first amino acid comprises a mutation at any one of positions 84-116 or 178-196 of the helicase amino acid sequence, relative to SEQ ID NO:32, to form an active, conformationally-constrained Rep helicase or homolog thereof.

8. The modified *E. coli* Rep helicase or homolog thereof of claim 6, wherein the second amino acid comprises a mutation at any one of positions 388-411, 422-444, and 518-540 of the helicase amino acid sequence, relative to SEQ ID NO:32, to form an active, conformationally-constrained Rep helicase or homolog thereof.

9. The modified helicase of claim 1 wherein the first amino acid and the second amino acid comprise an unnatural amino acid or a natural amino acid.

10. The modified helicase of claim 1 comprising a cysteine or homocysteine.

11. A modified helicase comprising a first subdomain comprising a 1A or 1B subdomain having a first amino acid and a second subdomain comprising a 2B subdomain having a second amino acid,
    wherein said first amino acid is less than about 20 Å from said second amino acid when the helicase is in an active conformation,
    wherein the first amino acid corresponds to any one of positions 84-116 or 178-196 of the helicase amino acid sequence, relative to SEQ ID NO:32;
    wherein the second amino acid corresponds to any one of positions 388-411, 422-444, and 518-540 of the helicase amino acid sequence, relative to SEQ ID NO:32;
    wherein a side chain of the first amino acid is covalently crosslinked to a side chain of the second amino acid with a linker to form an active, conformationally-constrained helicase;
    wherein the conformationally-constrained helicase comprises at least one degree of freedom less than a helicase that is not constrained as such;
    wherein said helicase is selected from the group consisting of a Rep helicase, a UvrD helicase, a PcrA helicase, or a homolog thereof;
    wherein the conformationally-constrained helicase enhances an unwinding function of the helicase; and
    wherein said helicase comprises a sequence selected from the group consisting of SEQ ID NOs:4 and 12.

12. The modified helicase of claim 1 wherein the first amino acid is covalently crosslinked to the second amino acid by a disulfide bond or a bis-maleimide crosslinker.

13. The modified helicase of claim 1 wherein the first amino acid is covalently crosslinked to the second amino acid by a chemical crosslinker having a length of from about 6 Å to about 25 Å.

14. The modified helicase of claim 1 wherein the first amino acid is covalently crosslinked to the second amino acid by a chemical crosslinker selected from the group consisting of:

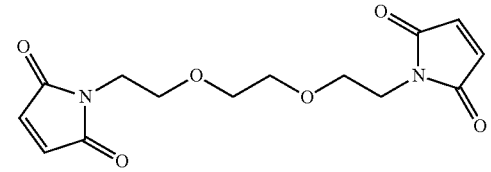 [SMILES: O=C1C=CC(=O)N1CCOCCOCCN1C(=O)C=CC1=O]

1-[2-[2-[2-(2,5-dioxopyrrol-1-yl)ethoxy]ethoxy]ethyl]pyrrole-2,5-dione,

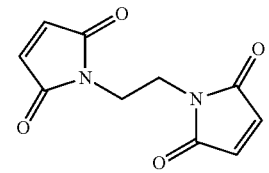

1-[2-(2,5-dioxopyrrol-1-yl)ethyl]pyrrole-2,5-dione,

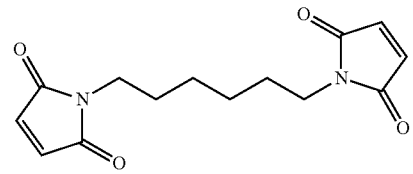 [SMILES: O=C1C=CC(=O)N1CCCCCCN1C(=O)C=CC1=O]

1-[6-(2,5-dioxopyrrol-1-yl)hexyl]pyrrole-2,5-dione,

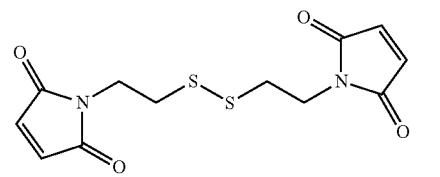 [SMILES: O=C1C=CC(=O)N1CCSSCCN1C(=O)C=CC1=O]

1-[2-[2-(2,5-dioxopyrrol-1-yl)ethyldisulfanyl]ethyl]pyrrole-2,5-dione,

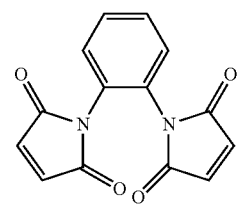 [SMILES: O=C1C=CC(=O)N1c1ccccc1N1C(=O)C=CC1=O]

1-[2-(2,5-dioxopyrrol-1-yl)phenyl]pyrrole-2,5-dione,

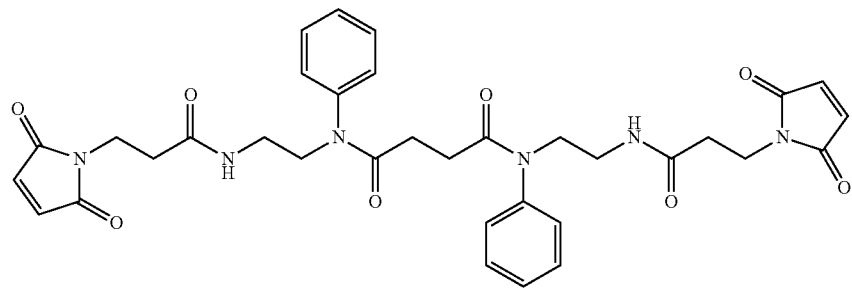 [SMILES: O=C(CCN1C(=O)C=CC1=O)NCCN(C(=O)CCC(=O)N(CCNC(=O)CCN1C(=O)C=CC1=O)c1ccccc1)c1ccccc1]
N,N'-bis[2-[3-(2,5-dioxopyrrol-1-yl)propanoylamino]ethyl]-N,N'-diphenylbutanediamide, and
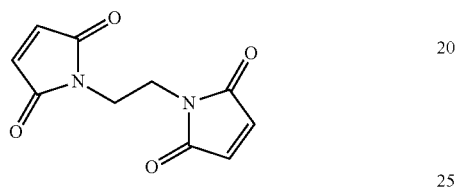
1-[2-(2,5-dioxopyrrol-1-yl)ethyl]pyrrole-2,5-dione.
* * * * *